(12) United States Patent
Delecluse et al.

(10) Patent No.: US 11,097,003 B2
(45) Date of Patent: Aug. 24, 2021

(54) EBV VACCINE

(71) Applicant: Deutsches Krebsforschungszentrum, Heidelberg (DE)

(72) Inventors: Henri-Jacques Delecluse, Heidelberg (DE); Anatoliy Shumilov, Heidelberg (DE); Ming-Han Tsai, Taoyuan (TW)

(73) Assignee: Deutsches Krebsforschungszentrum, Heidelberg (DE)

( * ) Notice: Subject to any disclaimer, the term of this patent is extended or adjusted under 35 U.S.C. 154(b) by 0 days.

(21) Appl. No.: 16/349,153

(22) PCT Filed: Nov. 10, 2017

(86) PCT No.: PCT/EP2017/078898
§ 371 (c)(1),
(2) Date: May 10, 2019

(87) PCT Pub. No.: WO2018/087296
PCT Pub. Date: May 17, 2018

(65) Prior Publication Data
US 2019/0282691 A1 Sep. 19, 2019

(30) Foreign Application Priority Data
Nov. 10, 2016 (EP) .................................... 16198150

(51) Int. Cl.
*A61K 39/245* (2006.01)
*A61P 31/22* (2006.01)
*C12N 7/00* (2006.01)
*A61K 39/12* (2006.01)

(52) U.S. Cl.
CPC ............ *A61K 39/245* (2013.01); *A61K 39/12* (2013.01); *A61P 31/22* (2018.01); *C12N 7/00* (2013.01); *C12N 2710/16223* (2013.01); *C12N 2710/16234* (2013.01)

(58) Field of Classification Search
CPC ............ A61K 2039/525; A61K 39/245; A61K 2039/5258; A61K 2039/5158; A61K 39/12; A61K 39/00; A61K 38/00; C07K 14/05; C12N 2710/16223; C12N 2710/16311; C12N 2710/16262; C12N 2710/0041; C12N 2710/10021; C12N 2710/16134; C12N 2710/16171; C12N 2710/16634; C12N 2710/16734; C12N 2710/20034; C12N 2710/16234; G01N 33/505; C12Q 1/705
See application file for complete search history.

(56) References Cited

U.S. PATENT DOCUMENTS 9,028,840 B2 * 5/2015 Adhikary ............. A61K 39/245
424/230.1
9,517,261 B2 * 12/2016 Feederle ................ A61K 39/12
2011/0059133 A1 * 3/2011 Adhikary ............. A61K 39/245
424/230.1
2014/0227305 A1 * 8/2014 Lange-Ruiss ........ A61K 39/245
424/186.1
2014/0322255 A1 * 10/2014 Feederle ................ A61K 39/12
424/186.1

FOREIGN PATENT DOCUMENTS

WO 2012025603 A1 3/2012
WO 2013098364 A1 7/2013

OTHER PUBLICATIONS

International Bureau of WIPO, International Preliminary Report on Patentability, dated May 14, 2019, 9pp.
Wen Deng et al., Epstein-Barr Virus Encoded Latent Membrane Protein 1 Impairs G2 Checkpoint in Human Nasopharyngeal Epithelial Cells through Defective Chk1 Activation, Plos|One, Jun. 25, 2012, 9 pages, retrieved from https://dio.org/10.1371/journal.pone.0039095.
Sophia Pavlova et al., An Epstein-Barr Virus Mutant Produces Immunogenic Defective Particles Devoid of Viral DNA, Journal of Virology, Feb. 2013, vol. 87, No. 4, p. 2011-2022, retrieved from http://jvi.asm.org/.
R. Feederle et al., Epstein-Barr Virus BNRF1 Protein Allows Efficient Transfer from the Endosomal Compartment to the Nucleus of Primary B Lymphocytes, Journal of Virology, vol. 80, No. 19, Oct. 2006, p. 9435-9443, retrieved from http://jvi.asm.org/.
Bernhard Neuhierl et al., Primary B-Cell Infection with a BALF4 Epstein-Barr Virus Comes to a Halt in the Endosomal Compartment yet Still Elicits a Potent CD4-Positive Cytotoxic T-Cell Response, Journal of Virology, vol. 83, No. 9, May 2009, p. 4616-4623, retrieved from http://jvi.asm.org/.
SA Kamranvar et al., Esptein-Barr Virus Promotes Genomic instability in Burkitt's Lymphoma, Department of Cell and Molecular Biology, Karolinska Institutet, Stockholm, Sweden, 2007, 9 pages, retrieved from www.nature.com/onc.
International Search Report and Written Opinion, International Patent Application No. PCT/EP2017/078898, dated Feb. 12, 2018, 12 pages.
Anatoliy Shumilov et al., Epstein-Barr Virus Particles Induce Centrosome Amplification and Chromosomal Instability, Nature Communications, vol. 8, Feb. 10, 2017, p. 14257.
Elliott D. Kieff et al.; Epstein-Barr Virus and Its Replication; Fields Virology; 2006; 52 pages; 5th Edition.
Ralf Küppers; B Cells Under Influence: Transformation of B Cells by Epstein-Barr Virus; Nature Reviews; Immunology; Oct. 2003; 12 pages; vol. 3.

(Continued)

*Primary Examiner* — Bao Q Li
(74) *Attorney, Agent, or Firm* — Taft Stettinius & Hollister LLP

(57) ABSTRACT

The present invention relates to a composition comprising Epstein-Barr Virus (EBV) particles for use in vaccination of a subject, wherein said EBV particles comprise a significantly reduced chromosome instability-inducing EBV polypeptide activity. The present invention also relates to a composition comprising EBV particles for use in vaccination of a subject, wherein said vaccination comprises avoiding contacting the cytosol and/or nucleus of cells of said subject with a chromosome instability-inducing EBV polypeptide activity. Moreover, the present invention relates to polynucleotides, host cells, methods, and uses related to the aforesaid compositions.

13 Claims, 11 Drawing Sheets

Figure 1:
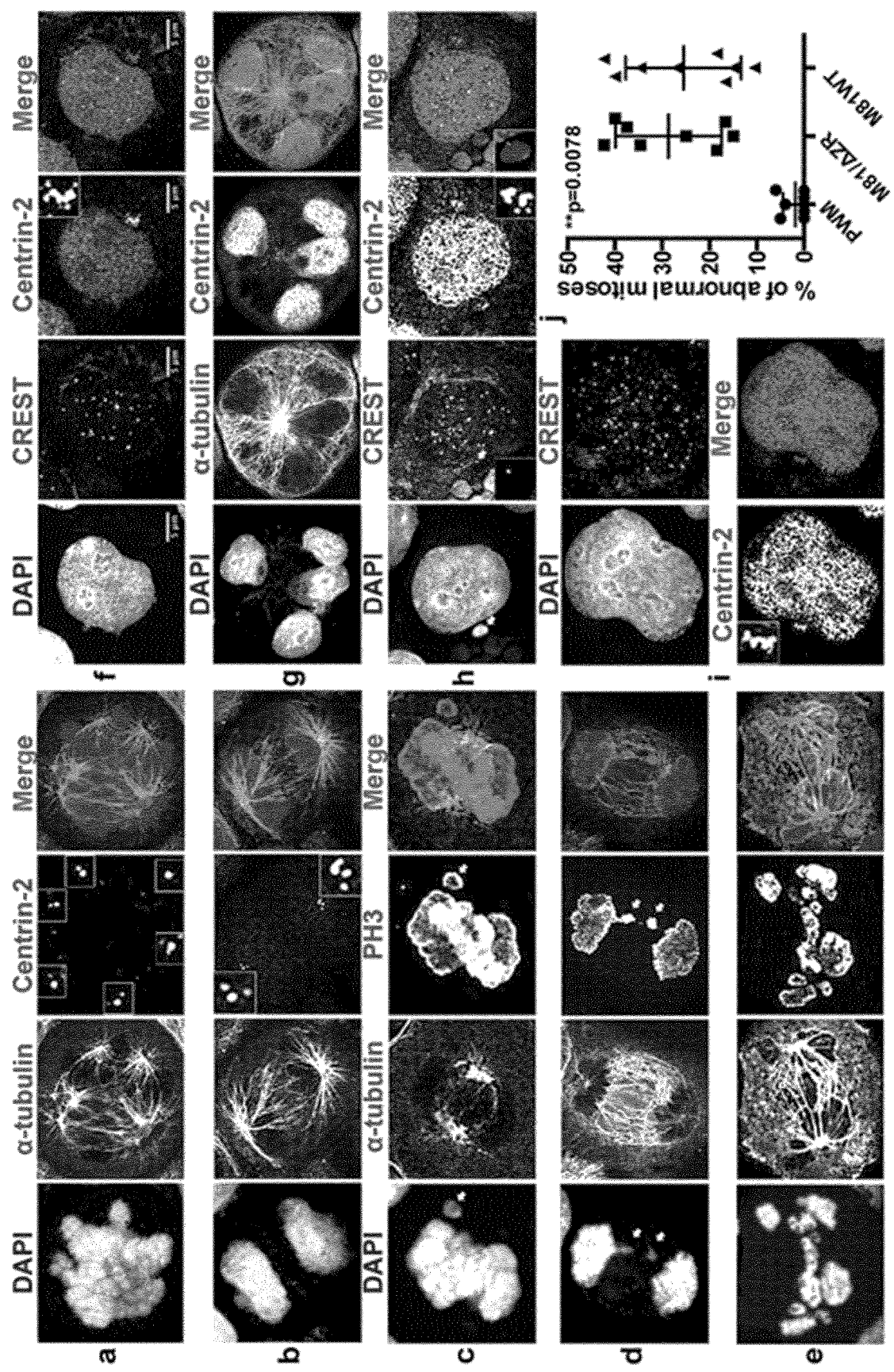

Specification includes a Sequence Listing.

(56) References Cited

OTHER PUBLICATIONS

Lauri L. Laichalk et al.; Terminal Differentiation into Plasma Cells Initiates the Replicative Cycle of Epstein-Barr Virus In Vivo; Journal of Virology; 2005; 13 pages; vol. 79, No. 2.

Alan B. Rickinson et al.; Epstein-Barr Virus; Fields Virology; 2006; 46 pages; 5th Edition.

Cliona M. Rooney et al.; Infusion of Cytotoxic T Cells for the Prevention and Treatment of Epstein-Barr Virus-Induced Lymphoma in Allogeneic Transplant Recipients; Blood; Sep. 1, 1998; 8 pages; vol. 92, No. 5.

Michiko Kawanishi; Epstein-Barr Virus Induces Fragmentation of Chromosomal DNA During Lytic Infection; Journal of Virology; 1993; 5 pages; vol. 67, No. 12.

Lesley Rees et al; A Phase I Trial of Epstein-Barr Virus Gp350 Vaccine for Children With Chronic Kidney Disease Waiting Transplantation; Clinical and Translational Research; 2009; 5 pages; vol. 88, No. 8.

Heather L. Greenstone et al.; Chimeric Papillomavirus Virus-Like Particles Elicit Antitumor Immunity Against the E7 Oncoprotein in an HPV16 Tumor Model; Proc. Natl. Acad. Sci. USA; Feb. 1998; 6 pages; vol. 95.

Bernard Roizman et al.; Herpes Simplex Viruses and Their Replication; Fields Virology; 2001; 62 pages; vol. 2; 4th Edition.

R. Feederle et al; Defective Infectious Particles and Rare Packaged Genomes Produced by Cells Carrying Terminal-Repeat-Negative Epstein-Barr Virus; Journal of Virology; 2005; 8 pages; vol. 79, No. 12.

Wolfgang Hammerschmidt et al.; Genetic Analysis of Immortalizing Functions of Epstein-Barr Virus in Human B Lymphocytes; Letters to Nature; 1989; 5 pages; vol. 340.

Michael Held et al.; CellCognition: Time-Resolved Phenotype Annotation in High-Throughput Live Cell Imaging; Nature Methods; Sep. 2010; 10 pages; vol. 7, No. 9.

Zhenye Yang et al.; Extra Centrosomes and/or Chromosomes Prolong Mitosis in Human Cells; Nature Cell Biology; Jun. 2008; 10 pages; vol. 10, No. 6.

Xiaochen Lin et al.; The Epstein-Barr Virus BART miRNA Cluster of the M81 Strain Modulates Multiple Functions in Primary B Cells; PLOS Pathogens; Dec. 22, 2015; 30 pages.

Ming-Han Tsai et al.; Spontaneous Lytic Replication and Epitheliotropism Define an Epstein-Barr Virus Strain Found in Carcinomas; Cell Reports; Oct. 31, 2013; 13 pages; vol. 5.

Dinesh Adhikary et al.; Immunodominance of Lytic Cycle Antigens in Epstein-Barr Virus-Specific CD4+ T Cell Preparations for Therapy; PLOS One; Jul. 2007; 10 pages; Issue 7.

Georg W. Bornkamm et al.; Stringent Doxycycline-Dependent Control of Gene Activities Using an Episomal One-Vector System; Nucleic Acids Research; 2005; 11 pages; vol. 33, No. 16.

Jochen B. Geigl et al; Multiplex-Fluorescence In Situ Hybridization for Chromosome Karyotyping; Nature Protocols; 2006; 13 pages; vol. 1, No. 3.

Onur Cizmecioglu et al.; Cep 152 Acts as a Scaffold for Recruitment of Plk4 and CPAP to the Centrosome; The Journal of Cell Biology; 2010; 9 pages; vol. 191, No. 4.

Jeffrey L Cohen et al.; Epstein-Barr Virus Nuclear Protein 2 is a Key Determinant of Lymphocyte Transformation; Proc. Natl. Acad. Sci. USA; Dec. 1989; 5 pages; vol. 86.

Kenneth M. Kaye et al.; Epstein-Barr Virus Latent Membrane Protein 1 is Essential for B-Lymphocyte Growth Transformation; Proc. Natl. Acad. Sci. USA; Oct. 1993; 5 pages; vol. 90.

B. Tomkinson et al.; Epstein-Barr Virus Nuclear Proteins EBNA-3A and EBNA-3C are Essential for B-Lymphocyte Growth Transformation; Journal of Virology; 1993; 13 pages; vol. 67, No. 4.

\* cited by examiner a b c

EBV VACCINE

CROSS-REFERENCE TO RELATED APPLICATIONS

This application is a U.S. National Phase of International PCT Application No. PCT/EP2017/078898 filed Nov. 10, 2017, which claims the benefit of European Patent Application Serial No. 16198150.1 filed Nov. 10, 2016, the contents of each application are incorporated herein by reference in their entirety.

The present invention relates to a composition comprising Epstein-Barr Virus (EBV) particles for use in vaccination of a subject, wherein said EBV particles comprise a significantly reduced chromosome instability-inducing EBV polypeptide activity. The present invention also relates to a composition comprising EBV particles for use in vaccination of a subject, wherein said vaccination comprises avoiding contacting the cytosol and/or nucleus of cells of said subject with a chromosome instability-inducing EBV polypeptide activity. Moreover, the present invention relates to polynucleotides, host cells, methods, and uses related to the aforesaid compositions.

The oncogenic Epstein-Barr virus (EBV) belongs to the family of gammaherpesviruses that can infect human B lymphocytes latently. The EBV establishes lifelong persistent B-cell infections in more than 90% of the human population (Kieff and B. Rickinson. (2006), Epstein-Barr virus and its replication, In D. M. Knipe and P. M. Howley (ed.), Fields virology, 5th ed. Lippincott-Raven, Philadelphia, Pa. 2603-2654; Küppers, R. (2003). B cells under influence: transformation of B cells by Epstein-Barr virus, Nat. Rev. Immunol. 3:801-812). In healthy individuals, the majority of EBV infected B cells show limited viral gene expression and a resting phenotype. The terminal differentiation of latently infected cells into plasma cells leads to virus reactivation, production, and reinfection of B cells (Laichalk, L. L., and D. A. Thorley-Lawson. (2005), Terminal differentiation into plasma cells initiates the replicative cycle of Epstein-Barr virus in vivo. J. Virol. 79:1296-1307). The expression of all viral latency genes causes growth transformation and the proliferation of infected B cells, which is reflected by the outgrowth of EBV-transformed lymphoblastoid B-cell lines in vitro and by the association of EBV with a variety of B-cell lymphoproliferative diseases, including different types of lymphoma, in vivo. EBV infection is controlled by T cells, as indicated by an increased incidence of EBV-associated malignancies in patients with congenital or iatrogenically induced T-cell dysfunction (Rickinson, A. B., and E. Kieff. (2006), Epstein-Barr virus, In D. M. Knipe and P. M. Howley (ed.), Fields virology, 5th ed. Lippincott-Raven, Philadelphia, Pa., 2655-2700) and by the successful treatment of EBV-associated posttransplant lymphoproliferative disease in hematopoietic stem cell transplant recipients by the infusion of polyclonal EBV-specific T-cell lines (Rooney, C. M., et al., (1998), Infusion of cytotoxic T cells for the prevention and treatment of Epstein-Barr virus-induced lymphoma in allogeneic transplant recipients. Blood 92:1549-1555). Besides inducing B-cell lymphoproliferation, EBV has been detected in lymphomas and in tumors of epithelial or mesenchymal origin such as nasopharyngeal carcinoma or leiomyosarcoma, which is why EBV was classified as a class I carcinogenic agent by the WHO International Agency for Research on Cancer (IARC). Besides expression of at least some viral latent genes, chromosomal aberrations, in particular translocations, are frequently found in such tumors. Such aberrations were identified to be associated with EBV lytic replication (Kawanishi M. Epstein-Barr virus induces fragmentation of chromosomal DNA during lytic infection. Journal of Virology 67, 7654-7658 (1993)).

EBV infection of target cells requires interaction of specific viral glycoproteins with receptors on the cell surface and fusion of the viral membrane with the membrane of the target cell. Binding of EBV to B-cells is known to require interaction of the gp350 viral glycoprotein with the cellular receptor CD21. Membrane fusion with a target cell is mediated by a complex of the gp85/gp25/gp42 glycoproteins of EBV, encoded by the BXLF2, BKRF2, and BZLF2 genes of EBV, respectively. Further, gp110, encoded by the viral BALF4 gene, is known to be required for escape of viral particles from the endosome after infection (Neuhierl et al. (2009), J Virol 83(9):4616); accordingly, it was assumed that gp110's function corresponds to its homolog in herpes simplex virus (gB), i.e. is mediating fusion of the viral membrane with the membrane of the endosome, thus causing release of the tegument and capsid of the viral particle into the cytoplasm of the infected cell. The BNRF1 gene of EBV is known to encode the major tegument protein that plays a role in transfer of viral particles from the endosome to the nucleus of B lymphocytes (Feederle et al. (2006), J Virol 80(19): 9435). However, the exact molecular basis for this role still remains to be elucidated.

Since EBV is a carcinogenic agent, there is a need in the art to develop a vaccine to prevent or clear EBV infection. Such a vaccine would preferred to be applied to an apparently healthy subject, so safety of such a vaccine would be a major concern. So far, there is only a peptidic vaccine against EBV gp350 commercially available. However, first clinical trials with this vaccine show it does not prevent EBV infection in EBV-negative transplant recipients (Rees L, et al. (2009), A phase I trial of Epstein-Barr virus gp350 vaccine for children with chronic kidney disease awaiting transplantation. Transplantation 88(8):1025-9).

Virus-like particles (VLPs) are structures similar or identical to mature virions but lack the viral genome. In general, they stimulate the host's immune response to a higher extent than e.g. monomeric peptides do, which is why they have been preferentially used for vaccination against several viruses such as hepatitis B and papillomavirus (Greenstone, H. L., et. al. (1998), Chimeric papillomavirus virus-like particles elicit antitumor immunity against the E7 oncoprotein in an HPV16 tumor model. Proc. Natl. Acad. Sci. USA 95:1800-1805; Mandic, A., and T. Vujkov. (2004). Human papillomavirus vaccine as a new way of preventing cervical cancer: a dream or the future? Ann. Oncol. 15:197-200). A crucial safety aspect of VLP vaccine regimes is that the VLPs used have to be free of viral genomes (DNA or RNA), since otherwise vaccination could induce virus replication and/or latent infection by the virus.

The viral lytic replication, i.e. the processes leading to the formation of progeny viral particles, of EBV and other herpesviruses is a complex process that results from sequential activation of different protein classes. During lytic replication, the viral genome is amplified several thousand times from the different origins of replication to form highly branched structures. These large concatemers are then resolved into unit-length linear viral genomes that will be packaged into preformed procapsids within the infected cell nucleus. Capsids containing viral DNA will undergo further conformational and structural changes and egress from the infected cell as enveloped virion particles (Roizman, B., and D. M. Knipe. (2001), Herpes simplex viruses and their replication, In D. M. Knipe, P. M. Howley, D. E. Griffin, R.

A. Lamb, M. A. Martin, B. Roizman, and S. E. Straus (ed.), Fields virology, 4th ed., vol. 2. Lippincott Williams & Wilkins, Philadelphia, Pa., 2399-2459). One essential cis element that leads to EBV encapsidation are the terminal repeats (TRs) located at both ends of the linear genome that are involved in the excision of individual viral genomes from the concatemers formed during viral lytic replication as well as in their packaging. An EBV mutant strain in which these terminal repeats had been deleted (delTR-EBV) has been generated. It has been shown that after induction of the lytic cycle a large amount of empty EB-VLPs is produced and that the efficiency of genome encapsidation is markedly low, since as few as 0.001% of cells infected with supernatants containing delTR-EBV express a marker gene from said genome, as compared to 29% when a control EBV is used (Feederle R, et al., (2005), Defective infectious particles and rare packaged genomes produced by cells carrying terminal-repeat-negative Epstein-Barr virus. J. Virol. 79; 7641-7). This indicates that the terminal repeats are important but not absolutely essential for genome encapsidation. Moreover, it has been shown that VLPs produced from delTR-EBV still—though rarely—infect cells, thus not warranting safety of the delTR-EBV VLPs for use as a vaccine. Accordingly, to increase safety of EBV particle-containing vaccines, it was further proposed to further delete genes encoding known transforming proteins LMP-1, EBNA-2, EBNA3a, EBNA-3b, and EBNA 3c from the EBV genome (cf. WO 2012/025603 A1).

In summary, notwithstanding the existing need, so far no method for producing a safe and efficient vaccine against EBV has been developed. Thus, the technical problem underlying the invention can be seen as the provision of means and methods which allow for the efficient production of an EBV vaccine. The technical problem is solved by the embodiments characterized in the claims and herein below.

Accordingly, the present invention relates to a composition comprising Epstein-Barr Virus (EBV) particles for use in vaccination of a subject, wherein said EBV particles comprise a significantly reduced chromosome instability-inducing EBV polypeptide activity.

As used in the following, the terms "have", "comprise" or "include" or any arbitrary grammatical variations thereof are used in a non-exclusive way. Thus, these terms may both refer to a situation in which, besides the feature introduced by these terms, no further features are present in the entity described in this context and to a situation in which one or more further features are present. As an example, the expressions "A has B", "A comprises B" and "A includes B" may both refer to a situation in which, besides B, no other element is present in A (i.e. a situation in which A solely and exclusively consists of B) and to a situation in which, besides B, one or more further elements are present in entity A, such as element C, elements C and D or even further elements.

Further, as used in the following, the terms "preferably", "more preferably", "most preferably", "particularly", "more particularly", "specifically", "more specifically" or similar terms are used in conjunction with optional features, without restricting further possibilities. Thus, features introduced by these terms are optional features and are not intended to restrict the scope of the claims in any way. The invention may, as the skilled person will recognize, be performed by using alternative features. Similarly, features introduced by "in an embodiment of the invention" or similar expressions are intended to be optional features, without any restriction regarding further embodiments of the invention, without any restrictions regarding the scope of the invention and without any restriction regarding the possibility of combining the features introduced in such way with other optional or non-optional features of the invention. Moreover, if not otherwise indicated, the term "about" relates to the indicated value with the commonly accepted technical precision in the relevant field, preferably relates to the indicated value ±20%, more preferably ±10%, most preferably ±5%.

The term "significant", as used herein, e.g. in the context of a significant change, a significant proportion, and a significant reduction, relates to statistical significance. Whether a deviation, change, or portion is statistically significant can be determined without further ado by the person skilled in the art using various well known statistic evaluation tools, e.g., determination of confidence intervals, p-value determination, Student's t-test, Mann-Whitney test etc. Preferred confidence intervals are at least 90%, at least 95%, at least 97%, at least 98% or at least 99%. The p-values are, preferably, 0.05, 0.01, 0.005, or 0.0001. Thus, preferably, a significantly reduced activity of a polypeptide preferably, relates to an activity deviating from a control activity with a p-value of at most 0.05, preferably of at most 0.01, more preferably of at most 0.005. Similarly, preferably, a significantly reduced amount of a compound, e.g. polypeptide, preferably, relates to an amount deviating from a control amount with a p-value of at most 0.05, preferably of at most 0.01, more preferably of at most 0.005.

According to nomenclature relating to EBV genes and their products, the designation used for a gene may also be used for the polypeptide which is the product of said gene. For clarity, as used herein, the term "X gene" relates to gene X, including an open reading frame potentially comprised therein and its regulatory sequences; the term "X RNA" relates to the RNA transcribed from the X gene, and "X polypeptide" relates to the polypeptide which is the product of translation of the X RNA. The terms "X activity" and "X polypeptide activity" relate to an activity mediated by the X polypeptide. As used herein, a variant of an EBV polypeptide having the ascribed activity is related to as a "functional EBV polypeptide", whereas a variant of an EBV polypeptide not having the ascribed activity, is related to as a "non-functional EBV polypeptide".

As used herein, the term "composition" relates to a composition of matter comprising at least the constituents indicated; preferably, it also envisaged that the composition comprises one or more additional component(s). Preferably, the composition consists of the compounds indicated. Preferably, the composition is a pharmaceutical composition, more preferably is a vaccine, as specified elsewhere herein.

The terms "Epstein-Barr virus" and "EBV" are known to the skilled person as relating to a virus being a member of the family herpesviridae, genus lymphocryptovirus, which is also known as human herpesvirus 4 (HHV-4). Several subtypes of EBV are known (e.g. EBV type 1: Genbank Acc No: NC_007605.1 GI: 82503188; genome: SEQ ID NO: 1; de Jesus 0 et al. (2003) J. Gen. Virol. 84, 1443-1450; and EBV type 2: Genbank Acc No: NC_009334.1 GI: 139424470; Dolan A et al. (2006) Virology Vol. 350, 164-170), genome: SEQ ID NO: 2, including strain M81 (SEQ ID NO: 3)). As used herein, the term "EBV particle" includes all particles comprising EBV structural polypeptides and having overall herpesviral particle structure. Thus, the term EBV particle includes infectious EBV particles and Epstein-Barr virus like particles as specified herein below. The term EBV particle also includes particles lacking in part or wholly a tegument, preferably lacking a functional BNRF1 polypeptide, more preferably completely lacking a BNRF1 polypeptide.

In addition to EBV-encoded proteins, the EBV particles may also comprise one or more artificial polypeptides. The term "artificial polypeptide" relates to any polypeptide incorporated into an EBV particle which is not comprised in a wildtype EBV. Preferably, the artificial polypeptide is a non-naturally occurring polypeptide. Whether an artificial polypeptide is incorporated into, and therefore comprised in, an EBV particle, can be assessed by obtaining EBV particles according to known methods, separating EBV particles from the producing cells, e.g. by centrifugation or by immuno-precipitation, followed by determining the presence of the artificial polypeptide in said EBV particles, which can be accomplished e.g. by an immunoassay or by any other method suited for the specific polypeptide and known to the artisan. Preferably, the artificial polypeptide is a fusion polypeptide comprising a membrane-integral part of a herpesviral glycoprotein. In a preferred embodiment, the artificial polypeptide further comprises a detectable tag. The term "detectable tag" refers to a stretch of amino acids which are added to or introduced into the fusion polypeptide of the invention. Preferably, the tag shall be added C- or N-terminally to the fusion polypeptide of the present invention. Said stretch of amino acids shall allow for detection of the fusion polypeptide by an antibody which specifically recognizes the tag or it shall allow for forming a functional conformation, such as a chelator or it shall allow for visualization by fluorescent tags. Preferred tags are the Myc-tag, FLAG-tag, 6-His-tag, HA-tag, GST-tag or GFP-tag. Appropriate tags are well known in the art. In a further preferred embodiment, said fusion protein comprises a peptide or polypeptide comprising the amino acid sequence of an immunogenic protein, preferably an immunogenic protein of a pathogenic microorganism, more preferably an EBV protein, most preferably a latent EBV protein.

It is, however, also envisaged by the present invention that one or more non-essential EBV polypeptides is or are lacking from the EBV particle. In the context of the present specification, "non-essential EBV polypeptide" relates to a polypeptide incorporated into wildtype EBV particles but not essential for the formation of such particles. Thus, preferably, non-essential EBV polypeptides are EBV polypeptides not essential for the formation of EBV particles as specified herein; thus, preferably non-essential EBV polypeptides are EBV polypeptides not essential for the formation of infectious EBV particles and are not essential for the formation of EB-VLPs. Accordingly, EBV terminal repeats, the BFLF1 gene and the BBRF1 gene are non-essential EBV polypeptides as used herein. A polypeptide is non-essential if EBV particles are detectable in the absence of such polypeptide from a producer cell by electron microcopy or one of the other methods known to the skilled person for detecting EBV particles, including, e.g. binding of EBV particles to suitable host cell, infection of suitable host cells by EBV particles, and the like. Methods how to omit a polypeptide from a host cell during lytic infection of EBV are well-known to the skilled artisan. Preferably, a polypeptide is omitted by deleting the gene coding for said polypeptide from the viral genome or by rendering said gene unexpressible by means of genetic manipulation, e.g. by mutating the start codon to a non-start codon.

Preferably, the non-essential EBV polypeptide is an EBV fusogenic polypeptide as specified herein below; thus, preferably, the EBV particles comprising a significantly reduced chromosome instability-inducing EBV polypeptide activity further are lacking one or more EBV fusogenic polypeptides as specified herein below.

Also preferably, the non-essential EBV polypeptide is a transforming EBV polypeptide. Thus, preferably, the EBV particles further lack at least one transforming EBV polypeptide. The term "transforming EBV polypeptide" is known to the skilled person as relating to a polypeptide encoded by an EBV genome and inducing, when present in a host cell, in particular an infection permissive human cell such as a B-cell, the cell to assume a transformed state in which proliferation is independent of at least some growth signals required by normal cells of said type. Thus, preferably, a transforming EBV polypeptide is an EBV polypeptide causing a permissive host cell to assume a cancer-like proliferative state. Preferably, the transforming EBV polypeptide is selected from the list consisting of the LMP-1 polypeptide, the LMP-2 polypeptide, the EBNA-2 polypeptide, the EBNA-3a polypeptide, and the EBNA-3c polypeptide. Also preferably, more than one transforming EBV polypeptide lacks from the EBV particles, more preferably at least two, even more preferably at least three, even more preferably at least four transforming EBV polypeptide are lacking from the EBV polypeptide. Most preferably five transforming EBV polypeptides, preferably the LMP-1 polypeptide, the LMP-2 polypeptide, the EBNA-2 polypeptide, the EBNA3a polypeptide, and the EBNA-3c polypeptide, are lacking from the EBV polypeptide. As used herein, the term "transforming EBV polypeptide", preferably, does not include the BNRF1 polypeptide.

The term "Epstein-Barr virus like particle" or "EB-VLP", as used herein, refers to a viral particle derived from an EBV, wherein less than 1%, preferably less than 0.1%, more preferably less than 0.01% of said particles comprise EBV DNA; more preferably, less than 1%, preferably less than 0.1%, more preferably less than 0.01% of said particles comprise DNA. Thus, preferably, EB-VLPs are neither replicating lytically nor establishing latent infection in a suitable host cell. EB-VLPs, preferably, have an overall herpesviral structure as analyzed by electron microscopy. Preferably, EB-VLPs comprise at least a capsid and an outer membrane. Preferably, the EB-VLPs comprise the EBV structural proteins essential for particle formation (e.g., capsid, coat, shell, surface or envelope proteins and glycoproteins) known to the skilled artisan for the known EBV types, preferably the EBV types as specified herein above.

The term "subject" relates to a metazoan organism with the capacity to generate an immune response to molecules foreign to the organism. Preferably, the subject is an animal, more preferably a mammal, even more preferably a human or an experimental animal, in particular a rat, a mouse, a rabbit, a guinea pig, a hamster, a sheep, a goat, a horse, a cow, a donkey, most preferably is a human. Preferably, an experimental animal is sacrificed after a method of the present invention is applied.

The term "vaccination", as used herein, relates to the administration of antigenic material to stimulate the immune system of a subject to develop adaptive immunity. Preferably, vaccination is therapeutic or prophylactic vaccination. As specified elsewhere herein, the EBV particle may comprise one or more non-EBV polypeptides; accordingly, EBV particles comprising at least one non-EBV immunogenic epitope may be used in vaccination of a subject against a non-EBV antigen. Preferably, said non-EBV antigen is an infectious agent, more preferably a non-EBV-virus, a bacterium, or a eukaryotic infectious agent or an immunogenic structure comprised therein. Preferably, the non-EBV antigen is a herpes virus, in particular a herpes simplex virus, a cytomegalovirus, or a human herpesvirus 8. More preferably, vaccination is vaccination against EBV infection.

Therapeutic vaccination refers to vaccination administered to ameliorate or cure a disease or a disorder of a subject referred to herein or the symptoms accompanied therewith to a significant extent. Therapeutic vaccination may lead to an entire restoration of health with respect to the diseases or disorders referred to herein. It is to be understood that therapeutic vaccination as used in accordance with the present invention may not be effective in all subjects. However, the term shall, preferably, require that a statistically significant portion of subjects suffering from a disease or disorder referred to herein can be successfully treated. Whether a portion is statistically significant can be determined without further ado by the person skilled in the art using various well known statistic evaluation tools discussed elsewhere in this specification. Preferably, therapeutic vaccination shall be effective for at least 25%, more preferably at least 50%, still more preferably at least 80%, most preferably at least 90% of the subjects of a given cohort or population.

Prophylactic vaccination relates to vaccination administered to retain health of a subject with respect to the diseases or disorders referred to herein for a certain period of time, preferably life-long, in a subject. It will be understood that said period of time may depend on the amount of the EBV particles which has been administered and on individual factors of the subject discussed elsewhere in this specification. It is to be understood that prophylactic vaccination may not be effective in all subjects treated with the EBV particles according to the present invention. However, the term requires that, preferably, a statistically significant portion of subjects of a cohort or population are effectively prevented from suffering from a disease or disorder referred to herein or its accompanying symptoms. Preferably, a cohort or population of subjects is envisaged in this context which normally, i.e. without prophylactic vaccination according to the present invention, would develop a disease or disorder as referred to herein. Whether a portion is statistically significant can be determined without further ado by the person skilled in the art using various well known statistic evaluation tools discussed elsewhere in this specification. Preferably, prophylactic vaccination shall be effective for at least 25%, more preferably at least 50%, still more preferably at least 80%, most preferably at least 90% of the subjects of a given cohort or population.

Vaccination with conventional EBV vaccines bears the risk of inducing transformation in cells of the vaccinated subject. Since, however, the vaccine of the present invention does not induce chromosomal aberrations, and since, in a preferred embodiment, the vaccines of the present invention are devoid of functional EBV DNA and/or of transforming EBV polypeptides, the vaccines proposed herein provide a good safety profile and can be used also with a non-terminally diseased subject. For the same reason, vaccination of young subjects can be envisaged. Thus, preferably, the subject vaccinated is a subject with an age less than one half, preferably less than one fourth, more preferably less than one fifth, most preferably less than one tenth of its average life expectancy. More preferably, the subject is a human of less than 18 years of age, preferably less than 15 years of age, more preferably less than ten years of age, most preferably of less than five years of age. Also preferably, the subject is suffering from immunodeficiency and/or is planned to undergo immunosuppressive treatment. Thus, preferably, the subject is a future transplant recipient. More preferably, the subject is a future recipient of an organ transplant and/or of a hematopoietic stem cell transplant, preferably an allogeneic hematopoietic stem cell transplant, more preferably an allogeneic bone marrow transplant. Preferably, the vaccination according to the present invention comprises avoiding induction of chromosomal aberrations.

The term "chromosomal instability-inducing EBV polypeptide", as used herein, relates to a polypeptide encoded by a wildtype EBV genome and having the activity of inducing instability of the genome of a host cell. Preferably, said chromosomal instability-inducing EBV polypeptide is a tegument polypeptide of EBV. Thus, preferably, the chromosomal instability-inducing EBV polypeptide is comprised in an EBV particle. Preferably the chromosomal instability-inducing EBV polypeptide is the BNRF1 polypeptide, the BPLF1 polypeptide, the BGLF3 polypeptide, the BRRF2 polypeptide, the BKRF4 polypeptide, or the BXLF1 polypeptide of EBV. More preferably the chromosomal instability-inducing EBV polypeptide is the BNRF1 polypeptide or the BPLF1 polypeptide of EBV; most preferably, the chromosomal instability-inducing EBV polypeptide is the BNRF1 polypeptide. Means and methods for determining the activity of a chromosomal instability-inducing EBV polypeptide are described herein in the Examples; preferably, said activity is determined by overproducing a gene of interest in a cell and comparing the number of chromosomal aberrations induced to a control, as specified herein in the Examples. As used herein, a variant of a chromosomal instability-inducing EBV polypeptide having the aforesaid activity, in particular mutagenic activity, is related to as a "functional chromosomal instability-inducing EBV polypeptide", whereas a variant of a chromosomal instability-inducing EBV polypeptide not having the aforesaid activity, in particular mutagenic activity, is related to as a "non-functional chromosomal instability-inducing EBV polypeptide". Thus, e.g., preferably a variant of a BNRF1 polypeptide having the aforesaid activity, in particular mutagenic activity, is related to as a "functional BNRF1 polypeptide", whereas a variant of a BNRF1 polypeptide not having the aforesaid activity, in particular mutagenic activity, is related to as a "non-functional BNRF1 polypeptide".

The term "BNRF1" is known to the skilled person as relating to the first rightward reading frame identifiable on the BamHI N fragment of EBV strain B95-8; for the avoidance of doubt, as used herein, the term "BNRF1" includes BNRF1 homologs from other EBV strains. Preferably, BNRF1 is BNRF1 from EBV strain B95-8, P3HR1, or M81. Preferably, as specified herein above, the term "BNRF1 polypeptide" relates to the polypeptide which is the product of translation of the BNRF1 RNA, which polypeptide is also known as the "major tegument protein" or "p140" of EBV. As will be understood, both the BNRF1 RNA and the BNRF1 polypeptide are products of the BNRF1 gene (i.e. are BNRF1 gene products). The amino acid sequence of the BNRF1 polypeptide of prototypic EBV strain B95-8 is available under Genbank Acc No: CAD53384.1 GI: 23893579, the amino acid sequence of the BNRF1 polypeptide of type-B EBV strain P3HR1 is available under Genbank Acc No: CAA47987.1 GI: 59166. The nucleic acid sequence of the BNRF1 gene of type-B EBV strain P3HR1 is available under Genbank Acc No: X67777.1 GI: 59165. Further sequences of BNRF1 polypeptides and genes are available in public databases The term "BNRF1 activity" relates to an activity mediated by the BNRF1 polypeptide. Preferably, BNRF1 activity is the activity of the BNRF1 polypeptide to mediate its own transport to the nucleus of a host cell and/or its mutagenic activity as specified herein in the examples. More preferably, BNRF1 activity is the mutagenic activity of the BNRF1 polypeptide, most preferably is the activity of BNRF1 to induce chromosome aberrations in a host cell. Means and methods for determining BNRF1 activity to mediate its own transport to the nucleus of a host cell are known to the skilled person, e.g. isolating nuclei from cells comprising the BNRF1 polypeptide or a variant thereof and determining the BNRF1 content of said isolated nuclei, e.g. by immunological methods. Methods for determining BNRF1 mutagenic activity are described herein in the Examples. Preferably, the EBV particle lacking BNRF1 activity is an EBV strain M81 particle produced from an EBV genome comprising the nucleic acid sequence shown in SEQ ID NO:4.

The term "BPLF1" is known to the skilled person as relating to the first leftward reading frame identifiable on the BamHI P fragment of EBV strain B95-8; for the avoidance of doubt, as used herein, the term "BPLF1" includes BPLF1 homologs from other EBV strains. Preferably, BPLF1 is BPLF1 from EBV strain B95-8, P3HR1, or M81. Preferably, as specified herein above, the term "BPLF1 polypeptide" relates to the polypeptide which is the product of translation of the BPLF1 RNA, which polypeptide is also known as the "large tegument protein deneddylase" of EBV. As will be understood, both the BPLF1 RNA and the BPLF1 polypeptide are products of the BPLF1 gene (i.e. are BPLF1 gene products). The amino acid sequence of the BPLF1 polypeptide of prototypic EBV strain B95-8 is available under Genbank Acc No: CAD53402.1 GI: 23893598. Further sequences of BPLF1 polypeptides and genes are available in public databases The term "BPLF1 activity" relates to an activity mediated by the BPLF1 polypeptide. Preferably, BPLF1 activity is the activity of the BPLF1 polypeptide to mediate its own transport to the nucleus of a host cell and/or its mutagenic activity as specified herein in the examples. More preferably, BPLF1 activity is the mutagenic activity of the BPLF1 polypeptide, most preferably is the activity of BPLF1 to induce chromosome aberrations in a host cell. Means and methods for determining BPLF1 activity to mediate its own transport to the nucleus of a host cell are known to the skilled person, e.g. isolating nuclei from cells comprising the BPLF1 polypeptide or a variant thereof and determining the BPLF1 content of said isolated nuclei, e.g. by immunological methods. Methods for determining BPLF1 mutagenic activity are described herein in the Examples.

The term "BGLF3" is known to the skilled person as relating to the third leftward reading frame identifiable on the BamHI G fragment of EBV strain B95-8; for the avoidance of doubt, as used herein, the term "BGLF3" includes BGLF3 homologs from other EBV strains. Preferably, BGLF3 is BGLF3 from EBV strain B95-8, P3HR1, or M81. Preferably, as specified herein above, the term "BGLF3 polypeptide" relates to the polypeptide which is the product of translation of the BGLF3 RNA. As will be understood, both the BGLF3 RNA and the BGLF3 polypeptide are products of the BGLF3 gene (i.e. are BGLF3 gene products). The amino acid sequence of the BGLF3 polypeptide of prototypic EBV strain B95-8 is available under Genbank Acc No: YP_401689.1 GI: 82503245. Further sequences of BGLF3 polypeptides and genes are available in public databases The term "BGLF3 activity" relates to an activity mediated by the BGLF3 polypeptide. Preferably, BGLF3 activity is the mutagenic activity of the BGLF3 polypeptide, most preferably is the activity of BGLF3 to induce chromosome aberrations in a host cell. Means and methods for determining BGLF3 activity are described herein in the Examples.

The term "BRRF2" is known to the skilled person as relating to the second rightward reading frame identifiable on the BamHI R fragment of EBV strain B95-8; for the avoidance of doubt, as used herein, the term "BRRF2" includes BRRF2 homologs from other EBV strains. Preferably, BRRF2 is BRRF2 from EBV strain B95-8, P3HR1, or M81. Preferably, as specified herein above, the term "BRRF2 polypeptide" relates to the polypeptide which is the product of translation of the BRRF2 RNA. As will be understood, both the BRRF2 RNA and the BRRF2 polypeptide are products of the BRRF2 gene (i.e. are BRRF2 gene products). The amino acid sequence of the BRRF2 polypeptide of prototypic EBV strain B95-8 is available under Genbank Acc No: P03210.1 GI: 141396. Further sequences of BRRF2 polypeptides and genes are available in public databases The term "BRRF2 activity" relates to an activity mediated by the BRRF2 polypeptide. Preferably, BRRF2 activity is the mutagenic activity of the BRRF2 polypeptide, most preferably is the activity of BRRF2 to induce chromosome aberrations in a host cell. Means and methods for determining BRRF2 activity are described herein in the Examples.

The term "BKRF4" is known to the skilled person as relating to the fourth rightward reading frame identifiable on the BamHI K fragment of EBV strain B95-8; for the avoidance of doubt, as used herein, the term "BKRF4" includes BKRF4 homologs from other EBV strains. Preferably, BKRF4 is BKRF4 from EBV strain B95-8, P3HR1, or M81. Preferably, as specified herein above, the term "BKRF4 polypeptide" relates to the polypeptide which is the product of translation of the BKRF4 RNA. As will be understood, both the BKRF4 RNA and the BKRF4 polypeptide are products of the BKRF4 gene (i.e. are BKRF4 gene products). The amino acid sequence of the BKRF4 polypeptide of prototypic EBV strain B95-8 is available under Genbank Acc No: P30117.1 GI: 267499. Further sequences of BKRF4 polypeptides and genes are available in public databases The term "BKRF4 activity" relates to an activity mediated by the BKRF4 polypeptide. Preferably, BKRF4 activity is the mutagenic activity of the BKRF4 polypeptide, most preferably is the activity of BKRF4 to induce chromosome aberrations in a host cell. Means and methods for determining BKRF4 activity are described herein in the Examples.

The term "BXLF1" is known to the skilled person as relating to the first leftward reading frame identifiable on the BamHI X fragment of EBV strain B95-8; for the avoidance of doubt, as used herein, the term "BXLF1" includes BXLF2 homologs from other EBV strains. Preferably, BXLF1 is BXLF1 from EBV strain B95-8, P3HR1, or M81. Preferably, as specified herein above, the term "BXLF1 polypeptide" relates to the polypeptide which is the product of translation of the BXLF1 RNA, also known as EBV thymidine kinase. As will be understood, both the BXLF1 RNA and the BXLF1 polypeptide are products of the BXLF1 gene (i.e. are BXLF2 gene products). The amino acid sequence of the BXLF1 polypeptide of prototypic EBV strain B95-8 is available under Genbank Acc No: YP_401701.1 GI: 82503257. Further sequences of BXLF1 polypeptides and genes are available in public databases The term "BXLF1 activity" relates to an activity mediated by the BXLF1 polypeptide. Preferably, BXLF1 activity is the mutagenic activity of the BXLF1 polypeptide, most preferably is the activity of BXLF1 to induce chromosome aberrations in a host cell. Means and methods for determining BXLF1 activity are described herein in the Examples.

In accordance with the above, the expression "EBV particles comprising a significantly reduced chromosome instability-inducing EBV polypeptide activity" relates to EBV particles as specified herein comprising a chromosome instability-inducing EBV polypeptide activity which is reduced in a statistically significant manner compared to an EBV particle produced in the presence of an unmodified, preferably wild-type, chromosome instability-inducing EBV polypeptide gene. Preferably, EBV particles comprising a significantly reduced chromosome instability-inducing EBV polypeptide activity are EBV particles comprising no detectable chromosome instability-inducing EBV polypeptide activity. More preferably, EBV particles comprising a significantly reduced chromosome instability-inducing EBV polypeptide activity are EBV particles comprising no chromosome instability-inducing EBV polypeptide activity detectable by the methods as specified herein in the Examples in $10^6$ particles. As used herein, the term relates to a reduction of all chromosome instability-inducing EBV polypeptide activity an infected host cell is exposed to; as will be understood by the skilled person, exposition of a host cell to chromosome instability-inducing EBV polypeptide activity may be caused by introduction of an active chromosome instability-inducing EBV polypeptide into the cytoplasm and/or the nucleus of the host cell; by introduction of a translation-competent chromosome instability-inducing EBV polypeptide encoding RNA into the cytoplasm and/or the nucleus of the host cell; and/or by introduction of an expressible chromosome instability-inducing EBV polypeptide encoding gene into the cytoplasm and/or the nucleus of the host cell. As will be understood by the skilled person, EBV particles comprising a significantly reduced chromosome instability-inducing EBV polypeptide activity may comprise a non-functional chromosome instability-inducing EBV polypeptide as specified herein; and/or chromosome instability-inducing EBV polypeptide encoding RNA encoding a non-functional chromosome instability-inducing EBV polypeptide; and/or a chromosome instability-inducing EBV polypeptide encoding gene encoding a non-functional chromosome instability-inducing EBV polypeptide.

Thus, e.g. preferably, the expression "EBV particles comprising a significantly reduced BNRF1 activity" relates to EBV particles as specified herein comprising a BNRF1 activity which is reduced in a statistically significant manner compared to an EBV particle produced in the presence of an unmodified, preferably wild-type, BNRF1 gene. Preferably, EBV particles comprising a significantly reduced BNRF1 activity are EBV particles comprising no detectable BNRF1 activity. More preferably, EBV particles comprising a significantly reduced BNRF1 activity are EBV particles comprising no BNRF1 activity detectable by the methods as specified herein in the Examples in $10^6$ particles. As used herein, the term relates to a reduction of all BNRF1 activity an infected host cell is exposed to; as will be understood by the skilled person, exposition of a host cell to BNRF1 activity may be caused by introduction of an active BNRF1 polypeptide into the cytoplasm and/or the nucleus of the host cell; by introduction of a translation-competent BNRF1 RNA into the cytoplasm and/or the nucleus of the host cell; and/or by introduction of an expressible BNRF1 gene into the cytoplasm and/or the nucleus of the host cell. As will be understood by the skilled person, exposition of a host cell to BNRF1 activity may also include introducing a BNRF1 gene product into a cellular organelle, in particular a centrosome. As used herein, EBV particles comprising a significantly reduced BNRF1 activity, preferably, comprise a significantly reduced amount of BNRF1 polypeptide, more preferably are free of a functional BNRF1 polypeptide, most preferably are free of a BNRF1 polypeptide. Also preferably, EBV particles comprising a significantly reduced BNRF1 activity comprise a significantly reduced amount of BNRF1 RNA, more preferably are free of an RNA encoding a functional BNRF1 polypeptide, most preferably are free of RNA encoding a BNRF1 polypeptide. Also preferably, EBV particles comprising a significantly reduced BNRF1 activity comprise a significantly reduced amount of BNRF1 gene, more preferably are free of a gene encoding a functional BNRF1 polypeptide, most preferably are free of a gene encoding a BNRF1 polypeptide. More preferably, EBV particles comprising a significantly reduced BNRF1 activity, preferably, comprise a significantly reduced amount of BNRF1 polypeptide and of BNRF1 RNA, more preferably are free of a functional BNRF1 polypeptide and of BNRF1 RNA, most preferably are free of a BNRF1 polypeptide and of BNRF1 RNA. Most preferably, EBV particles comprising a significantly reduced BNRF1 activity, preferably, comprise a significantly reduced amount of BNRF1 polypeptide, of BNRF1 RNA, and of the BNRF1 gene, more preferably are free of a functional BNRF1 polypeptide, of BNRF1 RNA, and of the BNRF1 gene, most preferably are free of a BNRF1 polypeptide, of BNRF1 RNA, and of the BNRF1 gene. Thus, preferably, the EBV particles are free of BNRF1 gene products. Accordingly, the EBV particles are preferably produced from an EBV genome lacking an functionally expressible BNRF1 gene, preferably lack an expressible BNRF1 gene. As will be understood by the skilled person, EBV particles comprising a significantly reduced BNRF1 activity may comprise a non-functional BNRF1 polypeptide as specified herein; and/or BNRF1 RNA encoding a non-functional BNRF1 polypeptide; and/or a BNRF1 gene encoding a non-functional BNRF1 polypeptide.

Preferably, the composition comprising EBV particles is a pharmaceutical composition. The term "pharmaceutical composition", as used herein, relates to a composition comprising the compound or compounds of the present invention in a pharmaceutically acceptable form and a pharmaceutically acceptable carrier. The compounds of the present invention can be formulated as pharmaceutically acceptable salts. Acceptable salts comprise acetate, methylester, HCl, sulfate, chloride and the like. The pharmaceutical compositions are, preferably, administered topically or, more preferably systemically. Suitable routes of administration conventionally used for drug administration are oral, intravenous, or parenteral administration as well as inhalation. Preferably, the pharmaceutical composition of the present invention is administered via a parenteral route, preferably subcutaneously, intramuscularly, intranasally, or intraperitoneally. In case the subject is a human, administration preferably is intramuscularly. However, polynucleotide compounds may also be administered in a gene therapy approach by using viral vectors, viruses or liposomes, and may also be administered topically, e.g. as an ointment. Moreover, the compounds can be administered in combination with other drugs either in a common pharmaceutical composition or as separated pharmaceutical compositions wherein said separated pharmaceutical compositions may be provided in form of a kit of parts. In particular, co-administration of adjuvants is envisaged, as specified elsewhere herein. Preferably, the EBV particles and the pharmaceutical composition are provided in lyophilized form.

The compounds are, preferably, administered in conventional dosage forms prepared by combining the drugs with standard pharmaceutical carriers according to conventional procedures. These procedures may involve mixing, granulating and compressing or dissolving the ingredients as appropriate to the desired preparation. It will be appreciated that the form and character of the pharmaceutically acceptable carrier or diluent is dictated by the type and amount of active ingredient with which it is to be combined, the route of administration and other well-known variables.

The carrier(s) must be acceptable in the sense of being compatible with the other ingredients of the formulation and being not deleterious to the recipient thereof. The pharmaceutical carrier employed may be, for example, either a solid, a gel or a liquid. Exemplary of solid carriers are lactose, terra alba, sucrose, talc, gelatin, agar, pectin, acacia, magnesium stearate, stearic acid and the like. Exemplary of liquid carriers are phosphate buffered saline solution, syrup, oil such as peanut oil and olive oil, water, emulsions, various types of wetting agents, sterile solutions and the like. Similarly, the carrier or diluent may include time delay material well known to the art, such as glyceryl monostearate or glyceryl distearate alone or with a wax. Said suitable carriers comprise those mentioned above and others well known in the art, see, e.g., Remington's Pharmaceutical Sciences, Mack Publishing Company, Easton, Pa.

The diluent(s) is/are preferably selected so as not to affect the biological activity of the EBV particle, the immunogenic polypeptide, polynucleotide, vector, or host cell and potential further pharmaceutically active ingredients. Examples of such diluents are distilled water, physiological saline, Ringer's solutions, dextrose solution, and Hank's solution. In addition, the pharmaceutical composition or formulation may also include other carriers, adjuvants, or nontoxic, nontherapeutic, nonimmunogenic stabilizers and the like.

An effective dose refers to an amount of the compounds to be used in a pharmaceutical composition of the present invention which elicits the effect of immunization of a subject. Therapeutic efficacy and toxicity of compounds can be determined by standard pharmaceutical procedures in cell culture or in experimental animals, e.g., by determining the ED50 (the dose therapeutically effective in 50% of the population) and/or the LD50 (the dose lethal to 50% of the population). The dose ratio between therapeutic and toxic effects is the therapeutic index, and it can be expressed as the ratio, LD50/ED50.

The dosage regimen will be determined by the attending physician, preferably taking into account relevant clinical factors and, preferably, in accordance with any one of the methods described elsewhere herein. As is well known in the medical arts, a dosage for any one patient may depend upon many factors, including the patient's size, body surface area, age, the particular compound to be administered, sex, time and route of administration, general health, and other drugs being administered concurrently. However, also a standard dose suitable for immunization of a particular species, in particular a human, may be established. Successful immunization can be monitored by periodic assessment. A typical dose can be, for example, in the range of 1 µg to 10000 µg, preferably per immunization; however, doses below or above this exemplary range are envisioned, especially considering the aforementioned factors. The pharmaceutical compositions and formulations referred to herein are administered at least once in order to establish immunization. However, the said pharmaceutical compositions may be administered more than one time, for example from two to four times. Also, boost immunizations may be envisaged for establishing or maintaining long-term immunity.

Specific pharmaceutical compositions are prepared in a manner well known in the pharmaceutical art and comprise at least an EBV particle, polynucleotide, vector, or host cell as an active compound in admixture or otherwise associated with a pharmaceutically acceptable carrier or diluent. For making those specific pharmaceutical compositions, the active compound(s) will usually be mixed with a carrier or the diluent, or enclosed or encapsulated in a capsule, sachet, cachet, paper or other suitable containers or vehicles. The resulting formulations are to be adopted to the mode of administration, i.e. in the forms of tablets, capsules, suppositories, solutions, suspensions or the like. Dosage recommendations shall be indicated in the prescriber or user instructions in order to anticipate dose adjustments depending on the considered recipient.

Advantageously, it was found in the work underlying the present invention that by removing chromosome instability-inducing EBV polypeptide from EBV particles, induction of chromosomal aberrations, e.g. in cells infected with EBV, can be avoided. Moreover, it was further found that avoiding induction of chromosome instability by EBV particles can also be achieved by preventing EBV particles from entering the cytosol and/or nucleus of a cells, e.g. by preventing fusion of the viral membrane with the cell membrane. Accordingly, it was found that safer vaccines comprising EBV particles, in particular EB VLPs, can be produced by providing EBV particles not introducing chromosome instability-inducing EBV polypeptide activity into the cytosol and/or nucleus of a cell.

The definitions made above apply mutatis mutandis to the following. Additional definitions and explanations made further below also apply for all embodiments described in this specification mutatis mutandis.

The present invention further relates to a composition comprising EBV particles for use in vaccination of a subject, wherein said vaccination comprises avoiding contacting the cytosol and/or nucleus of cells of said subject with a chromosome instability-inducing EBV polypeptide activity, preferably with BNRF1 activity.

As used herein, the term "avoiding contacting the cytosol and/or nucleus of cells with a chromosome instability-inducing EBV polypeptide activity", relates to actively ensuring that the cytosol and/or nucleus of cells is not contacted with a chromosome instability-inducing EBV polypeptide activity, preferably BNRF1 activity, as specified herein above by selecting appropriate EBV particles for vaccination.

Preferably, avoiding contacting the cytosol and/or nucleus of cells with a chromosome instability-inducing EBV polypeptide activity is accomplished by administering EBV particles comprising a significantly reduced chromosome instability-inducing EBV polypeptide activity, more preferably comprising no detectable chromosome instability-inducing EBV polypeptide activity for vaccination. As will be understood, for avoiding contacting the cytosol and/or nucleus of cells with a chromosome instability-inducing EBV polypeptide activity, preferably, exclusively EBV particles comprising no detectable chromosome instability-inducing EBV polypeptide activity are administered. More preferably, avoiding contacting the cytosol and/or nucleus of cells with a chromosome instability-inducing EBV polypeptide activity comprises avoiding contacting said subject with a functional chromosome instability-inducing EBV gene product, preferably comprises avoiding contacting said subject with a functional chromosome instability-inducing EBV polypeptide. More preferably, avoiding contacting the cytosol and/or nucleus of cells with a chromosome instability-inducing EBV polypeptide activity comprises avoiding contacting said subject with a functional BNRF1 gene product, preferably comprises avoiding contacting said subject with a functional BNRF1 polypeptide. More preferably, avoiding contacting the cytosol and/or nucleus of cells with a BNRF1 activity comprises avoiding contacting said subject with a BNRF1 gene product, preferably comprises avoiding contacting said subject with a BNRF1 polypeptide.

Also preferably, avoiding contacting the cytosol and/or nucleus of cells with a chromosome instability-inducing EBV polypeptide activity is accomplished by administering EBV particles comprising no detectable EBV fusogenic polypeptide activity. The terms "EBV fusogenic polypeptide" and "fusogenic EBV polypeptide", as used herein, relate to a polypeptide encoded by an EBV genome and having the activity of mediating or assisting in fusion of the EBV membrane with a cell membrane. Preferably, the EBV fusogenic polypeptide is a polypeptide essential for fusion; i.e. is a polypeptide which, when omitted from an EBV particle, causes said EBV particles to be non-fusogenic. Methods for identifying EBV fusogenic polypeptides are known in the art and include, e.g. removing the gene of interest from the EBV genome and observing infectivity of the resultant EBV particles. Preferably, said method for identifying further comprises detecting whether EBV particles accumulate in endosomal vesicles of a target cell. Preferably, said EBV fusogenic polypeptide is a polypeptide comprised in the membrane of an EBV particle. Thus, preferably, the EBV fusogenic polypeptide is comprised in an EBV particle. Preferably the EBV fusogenic polypeptide is the BALF4 polypeptide, the BXLF2 polypeptide, the BKRF2 polypeptide, or the BZLF2 polypeptide of EBV. More preferably the fusogenic polypeptide is the BALF4 polypeptide or the BXLF2 polypeptide of EBV; most preferably, the fusogenic EBV polypeptide is the BALF4 polypeptide. Means and methods for determining the activity of an EBV fusogenic polypeptide are known in the art. As used herein, a variant of an EBV fusogenic polypeptide having the aforesaid fusogenic activity is related to as a "functional EBV fusogenic polypeptide", whereas a variant of an EBV fusogenic polypeptide not having the aforesaid fusogenic activity is related to as a "non-functional EBV fusogenic polypeptide". Thus, e.g., preferably a variant of a BALF4 polypeptide having the aforesaid fusogenic activity is related to as a "functional BALF4 polypeptide", whereas a variant of a BALF4 polypeptide not having the aforesaid fusogenic activity is related to as a "non-functional BALF4 polypeptide". Also preferably, an EBV particle lacking EBV fusogenic polypeptide activity, preferably BALF4 activity as specified elsewhere herein, may be administered.

Preferably, the EBV fusogenic polypeptide is the BXLF2 polypeptide, i.e. is the polypeptide known to the skilled person as "gp85" or as "BXLF2 protein" of EBV. The amino acid sequence of BXLF2 polypeptide from EBV strain B95.8 is deposited under Genbank Acc No: CAD53450.1 GI: 23893646; moreover, further amino acid sequences of homologs from further EBV strains are available in public databases. Also, genes encoding BXLF2 polypeptides are available in public databases. Thus, the skilled person is able to ascertain whether a polypeptide is a BXLF2 polypeptide or not, e.g. by sequence alignment. Also, the skilled person in able to identify new BXLF2 genes, e.g. nucleic acid hybridization according to known methods.

Also preferably, the EBV fusogenic polypeptide is the BKRF2 polypeptide, i.e. is the polypeptide known to the skilled person as "gp25" or as "BKRF2 protein" of EBV. The amino acid sequence of BKRF2 polypeptide from EBV strain B95.8 is deposited under Genbank Acc No: P03212.1 GI: 140976; moreover, further amino acid sequences of homologs from further EBV strains are available in public databases. Also, genes encoding BKRF2 polypeptides are available in public databases. Thus, the skilled person is able to ascertain whether a polypeptide is a BKRF2 polypeptide or not, e.g. by sequence alignment. Also, the skilled person in able to identify new BKRF2 genes, e.g. nucleic acid hybridization according to known methods.

Also preferably, the EBV fusogenic polypeptide is the BZLF2 polypeptide, i.e. is the polypeptide known to the skilled person as "gp42" or as "BZLF2 protein" of EBV. The amino acid sequence of BZLF2 polypeptide from EBV strain B95.8 is deposited under Genbank Acc No: CAD53422.1 GI: 23893618; moreover, further amino acid sequences of homologs from further EBV strains are available in public databases. Also, genes encoding BZLF2 polypeptides are available in public databases. Thus, the skilled person is able to ascertain whether a polypeptide is a BZLF2 polypeptide or not, e.g. by sequence alignment. Also, the skilled person in able to identify new BZLF2 genes, e.g. nucleic acid hybridization according to known methods.

More preferably, the EBV fusogenic polypeptide is the BALF4 polypeptide, i.e. is the polypeptide known to the skilled person as "gp110", as "gp125", or as "BALF4 protein" of EBV. The amino acid sequence of BALF4 polypeptide from EBV strain B95.8 is deposited under Genbank Acc No: P03188.1 GI: 138191; moreover, further amino acid sequences of homologs from further EBV strains are available in public databases. Also, genes encoding BALF4 polypeptides are available in public databases. Thus, the skilled person is able to ascertain whether a polypeptide is a BALF4 polypeptide or not, e.g. by sequence alignment. Also, the skilled person in able to identify new BALF4 genes, e.g. nucleic acid hybridization according to known methods. The term "BALF4 activity" relates to an activity mediated by the BALF4 polypeptide. Preferably, BALF4 activity is the activity of the BALF4 polypeptide to mediate escape of EBV particles from endosomes and entry of EBV tegument polypeptides and capsids into the cytoplasm after infection. Means and methods for determining BALF4 activity are known to the skilled person. In accordance with the above, the expression "EBV particles comprising no detectable BALF4 activity" relates to EBV particles as specified herein comprising a BALF4 activity which is not detectable by the methods as specified herein. Thus, as used herein, EBV particles comprising no detectable BALF4 activity, preferably, are free of a functional BALF4 polypeptide, more preferably are free of a BALF4 polypeptide. Also preferably, EBV particles comprising a significantly reduced BALF4 activity are free of a gene encoding a functional BALF4 polypeptide, more preferably are free of a gene encoding a BALF4 polypeptide. Also preferably, EBV particles comprising no detectable BALF4 activity are free of a functional BALF4 polypeptide and of the BALF4 gene, most preferably are free of a BALF4 polypeptide and of the BALF4 gene. Thus, preferably, the EBV particles are free of BALF4 gene products. Accordingly, the EBV particles are preferably produced from an EBV genome lacking a functionally expressible BALF4 gene, preferably lack an expressible BALF4 gene. Also preferably, avoiding contacting the cytosol and/or nucleus of cells with a chromosome instability-inducing EBV polypeptide activity comprises avoiding contacting said subject with an EBV particle comprising gp85, gp25, gp42 and/or gp110 activity. More preferably, avoiding contacting the cytosol and/or nucleus of cells with a chromosome instability-inducing EBV polypeptide activity comprises avoiding contacting said subject with an EBV particle comprising gp110 activity. Accordingly, preferably, the composition comprises a significantly reduced BNRF1 activity and/or a significantly reduced gp110 activity, preferably is devoid of BNRF1 activity and/or devoid of gp110 activity. More preferably, the composition comprises EBV particles having a significantly reduced BNRF1 activity and/or having a significantly reduced gp110 activity, most preferably the composition comprises EBV particles devoid of BNRF1 activity and/or devoid of gp110 activity.

The present invention also relates to a polynucleotide encoding EBV particles comprising a significantly reduced chromosome instability-inducing EBV polypeptide activity for use in vaccination of a subject.

Moreover, the present invention relates to a polynucleotide encoding an EBV genome, wherein said EBV genome
a) lacks a gene encoding an active chromosome instability-inducing EBV polypeptide and/or lacks a gene encoding an active EBV fusogenic polypeptide, and
b) lacks EBV terminal repeat sequences and/or lacks at least one functionally expressible gene selected from the BFLF1 gene and the BBRF1 gene.

The term "polynucleotide", as used herein, refers to a linear or circular nucleic acid molecule. The polynucleotide of the present invention shall be provided, preferably, either as an isolated polynucleotide (i.e. isolated from its natural context) or in genetically modified form. The term encompasses single as well as double stranded polynucleotides. Moreover, comprised are also chemically modified polynucleotides including naturally occurring modified polynucleotides such as glycosylated or methylated polynucleotides or artificially modified derivatives such as biotinylated polynucleotides.

Preferably, in the polynucleotide encoding an EBV genome, at least one of the genes as specified herein is modified by introducing a deletion, addition and/or substitution of at least one nucleotide leading to a truncation, disruption or mutation of the protein produced from the said gene. Such modifications encompass point mutations in gene resulting in the generation of a stop codon as well as modifications resulting in a shift of the open reading frame. Such polypeptides being created are abnormally short or abnormally long and do not have the activity of the wildtype polypeptide, preferably, have no biological function. Also encompassed are point mutations in a gene which result in a polypeptide with no or with a decreased biological function. Also preferably, a deletion, addition and/or substitution of at least one nucleotide can be, preferably, introduced which leads to an inactivation of the transcriptional control sequence (i.e. the promoter) which governs expression of the gene. Moreover, sequences may be, preferably, introduced which in the transcribed RNA result in increased RNA degradation. More preferably, the entire locus for the at least one the of genes supra is deleted or replaced by a non-functional or non-expressible nucleic acid. Most preferably, the open reading frame is substituted by a selectable marker gene, such as the kanamycin resistance gene as indicated in the Figures and Examples, below, or the open reading frame is deleted.

The test if a given modification of one of the genes supra leads to a non-expressible gene will depend on the nature of the modification introduced as will be known to the skilled artisan. E.g. if a large part of the coding sequence of a gene has been deleted, electrophoretic separation of EBV proteins followed by immunoblotting with an antibody specific for the protein product of said gene will be appropriate, since the product of the gene containing the deletion will have a lower apparent molecular mass. On the other hand, if one of the genes supra is deleted entirely, restriction analysis of the resulting EBV genome proving deletion may be sufficient. In each case, loss of the function of one of the genes supra can be assayed by detecting or not corresponding activity in EBV particles.

The polynucleotide of the present invention is a polynucleotide comprising an EBV genome with the biological activity of directing production of EBV particles according to the present invention in a suitable host cell. Suitable assays for measuring said activity are described in the accompanying examples.

Moreover, the term "polynucleotide", as used in accordance with the present invention, further encompasses variants of the aforementioned specific polynucleotides. Said variants may represent strain or clonal variants of the polynucleotide of the present invention. The polynucleotide variants, preferably, comprise a nucleic acid sequence characterized in that the sequence can be derived from the aforementioned specific nucleic acid sequences by at least one nucleotide substitution, addition and/or deletion whereby the variant nucleic acid sequence shall still encode an EBV genome having the activity as specified above. A polynucleotide comprising a fragment of any of the aforementioned nucleic acid sequences is also encompassed as a polynucleotide of the present invention. The fragment shall encode an EBV genome which still has the activity as specified above.

The polynucleotides of the present invention either essentially consist of the aforementioned nucleic acid sequences or comprise the aforementioned nucleic acid sequences. Thus, they may contain further nucleic acid sequences as well. Specifically, the polynucleotides of the present invention may encode fusion proteins wherein one partner of the fusion protein is a polypeptide being encoded by a nucleic acid sequence recited above. Such fusion proteins may comprise as additional part polypeptides for monitoring expression (e.g., green, yellow, blue or red fluorescent proteins, alkaline phosphatase and the like) or so called "tags" which may serve as a detectable marker or as an auxiliary measure for purification purposes. Tags for the different purposes are well known in the art and comprise FLAG-tags, 6-histidine-tags, MYC-tags and the like.

Preferably, the polynucleotide of the present invention comprises alterations in addition to the modifications detailed above. Especially, since some of the latent gene products of EBV are known or suspected to have a transforming effect on cells (EBNA-2, LMP-1, LMP-2, EBNA-3A, and —C, the BHRF1 polypeptide, and the BART-miRNAs (Hammerschmidt W, Sudgen B (1989) Genetic analysis of immortalizing functions of Epstein-Barr virus in human B-lymphocytes. Nature 340: 393-397; Cohen J I, et al. (1989) Epstein-Barr virus nuclear protein 2 is a key determinant of lymphocyte transformation. PNAS 86:9558-9562; Kaye K M, et al. (1993) Epstein-Barr virus latent membrane protein 1 is essential for B-lymphocyte growth transformation. PNAS, 90, 9150-9154; Tomkinson B, et al. (1993) Epstein-Barr virus nuclear proteins EBNA3A and EBNA3C are essential for B-lymphocyte growth transformation. J. Virol. 62:6762-6771)), it is desirable to remove the genes coding for these transforming proteins from the polynucleotide of the present invention.

The term "terminal repeat" in the context of EBV genomes is known to the skilled person to relate to repetitive sequences comprised in EBV genomes at the 5' terminus and the 3' terminus of the linear genome, e.g. as packaged in EBV particles. EBV genomes lacking terminal repeats are known in the art, e.g. from WO 2012/025603 A1, disclosing that EBV particles produced from genomes lacking terminal repeats (TR-EBV) contain a significantly reduced number of EBV genomes per particles.

EBV genes "BFLF1" and "BBRF1" are also known to the skilled person and have been described to be essential for packaging of viral DNA into particles, e.g. in WO 2013/098364. Thus, from an EBV genome which lacks at least one functionally expressible gene selected from the BFLF1 gene and the BBRF1 gene, EBV particles comprising no detectable EBV DNA are produced. Relevant sequence are available in public databases, e.g. a sequence for an EBV type 1 BFLF1 gene: Genbank Acc. No: YP_401648.1 GI: 82503206; a sequence for an EBV type 2 BFLF1 gene: Genbank Acc. No: YP_001129444.1 GI: 139424479. A sequence for an EBV type 1 BBRF1 gene: Genbank Acc. No: YP_401682.1 GI: 82503238; a sequence for an EBV type 2 BBRF1 gene: Genbank Acc. No: YP_001129476.1 GI: 123811640.

Preferably, the polynucleotide further comprises at least one nucleic acid sequence encoding a non-EBV polypeptide, more preferably an artificial non-EBV polypeptide. Also preferably, the polynucleotide further lacks at least one expressible gene encoding a non-essential EBV polypeptide, preferably encoding a transforming EBV polypeptide, more preferably encoding an expressible EBV latent gene, most preferably, lacking a gene selected from the group consisting of BZLF1, LMP-1, LMP-2, EBNA-2, EBNA-3a, and EBNA-3c.

Further, the present invention relates to a vector comprising the polynucleotide according to the present invention.

Preferably, the vector is a plasmid or viral vector capable of stably maintaining an EBV genome in a cell. More preferably, the vector is derived from the *Escherichia coli* (*E. coli*) F-Plasmid; these vectors are known to the skilled person as F-factor based replicon or bacterial artificial chromosome (BAC), which allow for stably maintaining a complete EBV genome e.g. in *E. coli* bacterial cells. Moreover, the term also relates to targeting constructs which allow for random or site-directed integration of the targeting construct into genomic DNA. Such target constructs, preferably, comprise DNA of sufficient length for either homologous recombination or heterologous insertion. The vector encompassing the polynucleotides of the present invention, preferably, further comprises selectable markers for propagation and/or selection in a host. The vector may be incorporated into a host cell by various techniques well known in the art. If introduced into a host cell, the vector may reside in the cytoplasm or may be incorporated into the genome. In the latter case, it is to be understood that the vector may further comprise nucleic acid sequences which allow for homologous recombination or heterologous insertion. Vectors can be introduced into prokaryotic or eukaryotic cells via conventional transformation or transfection techniques. Vectors and transformation or transfection techniques are well known in the art and can be applied by the person skilled in the art without further ado. For example, a BAC plasmid vector can be introduced into *E. coli* cells by electroporation, or into mammalian cells in a complex with charged lipids.

Further, the present invention relates to a host cell comprising a polynucleotide of the present invention and/or a vector of the present invention.

"Host cells", as referred to herein, encompass eukaryotic cells as well as prokaryotic cells. In particular, prokaryotic cells referred to in accordance with the present invention may be bacterial cells that can be used for the propagation of, e.g., the polynucleotide or vector of the present invention. Preferred bacteria for this purpose are *E. coli* bacteria, more preferably strain DH10B. Eukaryotic cells are, preferably, cells which are capable of expressing genes of the EBV genome comprised in the polynucleotide or vector of the invention. Preferred cells expressing genes of the latent cycle of the EBV life cycle are, e.g., Raji cells. More preferably, said cells are capable of assembling EBV particles, i.e. permissive host cells. The term "permissive host cell" as used herein relates to a cell capable of facilitating lytic replication of EBV, leading to the production of EBV particles. Preferably, said permissive cell is a mammalian cell, more preferably a primate cell, even more preferably a human cell. Most preferably, the host cell is a 293 cell, a B cell or B cell-derived cell line. It is also envisaged by the current invention that the host cell may provide certain factors essential for lytic replication of EBV. E.g. where an EBV genome lacking a functional BZLF1 gene is used, which causes the virus to be unable to enter the lytic cycle, such function may be provided by the host cell after an expression construct for said BZLF1 gene, of the BRLF1 gene, or both genes, has been transfected into the cell.

Also, the present invention relates to an EBV particle produced or producible from the polynucleotide of the present invention and/or the vector of the present invention.

Further, the present invention relates to a use of an EBV particle comprising a significantly reduced BNRF1 activity, of an EBV polynucleotide according to the present invention, of the vector according to the present invention and/or of the host cell according to the present invention for manufacturing a vaccine.

The present invention also relates to a method for manufacturing EB-VLPs comprising a significantly reduced activity of a chromosome instability-inducing EBV polypeptide and/or a significantly reduced activity of an EBV fusogenic polypeptide and comprising a significantly reduced amount of EBV DNA, said method comprising the steps of:

a) culturing permissive host cells comprising the polynucleotide according to the present invention and/or the vector of the present invention; and b) obtaining EB-VLPs from said permissive host cells.

The method for manufacturing EB-VLPs of the present invention, preferably, is an in vitro method. Moreover, it may comprise steps in addition to those explicitly mentioned above. For example, further steps may relate, e.g., to providing a BZLF1 gene product within said permissive host cells for step a), or removing permissive host cells and/or obtaining EB-VLPs from the supernatant of the cultured permissive host cells in step b). Moreover, one or more of said steps may be performed by automated equipment.

The present invention also relates to a method for the manufacture of a vaccine comprising the steps of the method for manufacturing EB-VLPs and the further step of formulating the EB-VLPs as a vaccine.

Also, the present invention relates to a method for vaccinating a subject, said method comprising contacting said subject with a composition comprising EBV particles, wherein said method comprises avoiding contacting the cytosol and/or nucleus of cells of said subject with a BNRF1 activity.

The present invention, moreover, relates to a method for vaccinating a subject, said method comprising contacting said subject with (i) an EBV particle comprising a significantly reduced activity of the BNRF1 polypeptide, (ii) a polynucleotide according to the present invention, (iii) a vector according to the present invention, (iv) a host cell according to the present invention, (v) an EBV particle according to the present invention, (vi) a composition according to the present invention; or (vii) any combination of (i) to (vi).

Further, the present invention relates to a composition comprising EB-VLPs comprising a significantly reduced activity of the BNRF1 polypeptide and/or a significantly reduced activity of the gp110 polypeptide and comprising a significantly reduced amount of EBV DNA obtainable by a method comprising the steps of the method for manufacturing EB-VLPs as specified herein above.

In view of the above, the following embodiments are particularly preferred:

1. A composition comprising Epstein-Barr Virus (EBV) particles for use in vaccination of a subject, wherein said EBV particles comprise a significantly reduced chromosome instability-inducing EBV polypeptide activity, preferably a reduced BNRF1 activity.

2. The composition of embodiment 1, wherein said EBV particles comprise a significantly reduced amount of EBV DNA.

3. The composition for use of embodiment 1 or 2, wherein said EBV particles are free of EBV DNA.

4. The composition for use of any one of embodiments 1 to 3, wherein said EBV particles are Epstein-Barr virus-like particles (EB-VLPs).

5. The composition for use of any one of embodiments 1 to 4, wherein said EBV particles are free of a functional BNRF1 polypeptide, of a functional BPLF1 polypeptide, of a functional BGLF3 polypeptide, of a functional BRRF2 polypeptide, of a functional BKRF4 polypeptide, and/or of a functional BXLF1 polypeptide, preferably are free of a functional BNRF1 polypeptide.

6. The composition for use of any one of embodiments 1 to 5, wherein said EBV particles comprise a significantly reduced amount of BNRF1 gene products.

7. The composition for use of any one of embodiments 1 to 6, wherein said EBV particles are free of BNRF1 gene products.

8. The composition for use of any one of embodiments 1 to 7, wherein said EBV particles are produced from an EBV genome lacking an functionally expressible BNRF1 gene, preferably lack an expressible BNRF1 gene.

9. The composition for use of any one of embodiments 1 to 8, wherein said EBV particles further comprise at least one non-EBV polypeptide, preferably an artificial non-EBV polypeptide.

10. The composition for use of any one of embodiments 1 to 9, wherein said EBV particles further lack at least one non-essential EBV polypeptide activity, preferably lack EBV gp110 activity.

11. The composition for use of any one of embodiments 1 to 10, wherein said EBV particles further lack at least one transforming EBV polypeptide.

12. The composition for use of any one of embodiments 1 to 11, wherein said vaccination is vaccination against EBV infection.

13. The composition for use of any one of embodiments 1 to 12, wherein said vaccination is vaccination of a non-terminally diseased subject.

14. The composition for use of any one of embodiments 1 to 13, wherein said subject is a subject with an age less than one half, preferably less than one fourth, more preferably less than one fifth, most preferably less than one tenth of its average life expectancy.

15. The composition for use of any one of embodiments 1 to 14, wherein said subject is a human of less than 18 years of age, preferably less than 15 years of age, more preferably less than ten years of age, most preferably of less than five years of age.

16. The composition for use of any one of embodiments 1 to 15, wherein said subject is suffering from immunodeficiency and/or is planned to undergo immunosuppressive treatment.

17. The composition for use of any one of embodiments 1 to 16, wherein said subject is a future transplant recipient.

18. The composition for use of any one of embodiments 1 to 17, wherein said subject is a future recipient of an organ transplant and/or of a hematopoietic stem cell transplant, preferably an allogeneic hematopoietic stem cell transplant, more preferably an allogeneic bone marrow transplant.

19. The composition for use of any one of embodiments 1 to 18, wherein said vaccination comprises avoiding induction of chromosomal aberrations.

20. The composition for use of any one of embodiments 1 to 20, wherein said composition is a pharmaceutical composition.

21. A composition comprising EBV particles for use in vaccination of a subject, wherein said vaccination comprises avoiding contacting the cytosol and/or nucleus of cells of said subject with a chromosome instability-inducing EBV polypeptide activity, preferably comprises avoiding contacting the cytosol and/or nucleus of cells of said subject with a BNRF1 activity.

22. The composition for use of embodiment 21, wherein said avoiding contacting the cytosol and/or nucleus of cells with a chromosome instability-inducing EBV polypeptide activity comprises avoiding contacting said subject with a BNRF1 gene product, preferably comprises avoiding contacting said subject with a BNRF1 polypeptide.

23. The composition for use of embodiment 21 or 22, wherein said avoiding contacting the cytosol and/or nucleus of cells with a chromosome instability-inducing EBV polypeptide activity comprises avoiding contacting said subject with an EBV particle comprising EBV fusogenic polypeptide activity, preferably comprises contacting said subject with an EBV particle lacking the BALF4 polypeptide, the BXLF2 polypeptide, the BKRF2 polypeptide, and/or the BZLF2 polypeptide of EBV, more preferably comprises avoiding contacting said subject with an EBV particle comprising the BALF4 polypeptide, the BXLF2 polypeptide, the BKRF2 polypeptide, and/or the BZLF2 polypeptide of EBV.

24. The composition for use of any one of embodiments 21 to 23, wherein said composition comprises a significantly reduced BNRF1 activity and/or a significantly reduced gp110 activity, preferably is devoid of BNRF1 activity and/or devoid of gp110 activity.

25. The composition for use of any one of embodiments 21 to 23, wherein said composition comprises EBV particles having a significantly reduced BNRF1 activity and/or having a significantly reduced gp110 activity.

26. The composition for use of any one of embodiments 21 to 24, wherein said composition comprises EBV particles devoid of BNRF1 activity and/or devoid of gp110 activity.

27. A polynucleotide encoding EBV particles as specified in any one of embodiments 2 to 11 for use in vaccination of a subject.

28. A polynucleotide encoding an EBV genome, wherein said EBV genome a) lacks a gene encoding a functional chromosome instability-inducing EBV polypeptide and/or lacks a gene encoding a functional EBV fusogenic polypeptide, and b) lacks EBV terminal repeat sequences and/or lacks at least one functionally expressible gene selected from the BFLF1 gene and the BBRF1 gene.

29. The polynucleotide according to embodiment 27 or 28, wherein said polynucleotide further comprises at least one nucleic acid sequence encoding a non-EBV polypeptide, preferably an artificial non-EBV polypeptide.

30. The polynucleotide according to any one of embodiments 27 to 29, wherein said polynucleotide further lacks at least one expressible gene encoding a non-essential EBV polypeptide.

31. The polynucleotide according to any one of embodiments 27 to 30, wherein said polynucleotide further lacks at least one expressible gene encoding a transforming EBV polypeptide.

32. The polynucleotide according to any one of embodiments 27 to 31, wherein said polynucleotide further lacks at least one expressible EBV latent gene.

33. The polynucleotide according to any one of embodiments 27 to 32, wherein said polynucleotide further lacks at least one expressible gene selected from the group consisting of BZLF1, LMP-1, LMP2, EBNA-2, EBNA3a, and EBNA 3c.

34. A vector comprising the polynucleotide according to any one of embodiments 27 to 33.

35. A host cell comprising the polynucleotide of any one of embodiments 27 to 33 and/or the vector of embodiment 34.

36. An EBV particle produced or producible from the polynucleotide of any one of embodiments 27 to 33 and/or the vector of embodiment 34.

37. Use of an EBV particle as specified in embodiments 1 to 11, of an EBV polynucleotide according to any one of embodiments 27 to 33, of the vector according to embodiment 34 and/or of the host cell according to embodiment 35 for manufacturing a vaccine.

38. A method for manufacturing EB-VLPs comprising a significantly reduced activity of the BNRF1 polypeptide and/or a significantly reduced activity of the gp110 polypeptide and comprising a significantly reduced amount of EBV DNA, said method comprising the steps of:
    a) culturing permissive host cells comprising the polynucleotide according to any one of embodiments 27 to 33 and/or the vector of embodiment 34; and
    b) obtaining EB-VLPs from said permissive host cells.

39. The method of embodiment 38, wherein said EB-VLPs are obtained from the supernatant of the cultured permissive host cells.

40. A method for the manufacture of a vaccine comprising the steps of the method of embodiment 38 or 39 and the further step of formulating the EB-VLPs as a vaccine.

41. A composition comprising EB-VLPs comprising a significantly reduced activity of the chromosome instability-inducing EBV polypeptide and/or a significantly reduced activity of an EBV fusogenic polypeptide and comprising a significantly reduced amount of EBV DNA obtainable by a method comprising the steps of the method of embodiment 38 or 39.

42. A method for vaccinating a subject, said method comprising contacting said subject with a composition comprising EBV particles, wherein said method comprises avoiding contacting the cytosol and/or nucleus of cells of said subject with a chromosome instability-inducing EBV polypeptide activity, preferably, comprises avoiding contacting the cytosol and/or nucleus of cells of said subject with a BNRF1 activity.

43. A method for vaccinating a subject comprising contacting said subject with
    (i) an EBV particle as specified in any one of embodiments 1 to 11,
    (ii) a polynucleotide according to any one of embodiments 27 to 33,
    (iii) a vector according to embodiment 34,
    (iv) a host cell according to embodiment 35,
    (v) an EBV particle according to embodiment 36,
    (vi) a composition according to embodiment 41; or
    (vii) any combination of (i) to (vi).

All references cited in this specification are herewith incorporated by reference with respect to their entire disclosure content and the disclosure content specifically mentioned in this specification.

FIGURE LEGENDS

FIG. 1: B cells infected by the Epstein-Barr virus display features of chromosomal instability. Cells were kept in culture for 3 or 6 days after infection, cytospinned and stained for alpha-tubulin, centrin-2, PH3, a marker of mitotic chromosomes, or CREST, a marker of centromeres. We report the analysis of 8 blood samples. For each sample, at least 100 mitoses and 500 interphase cells from cytospinned infected cells were examined. (a) Cell undergoing a multipolar mitosis organized around 6 centrosomes. (b) Cell in anaphase organized around an increased number of centrioles. (c) The picture shows a non-aligned chromosome (arrow) in a cell undergoing metaphase. (d) This cell in anaphase shows two lagging chromosomes (arrows). (e) Mitotic cell showing asymmetric partition of the chromosomes. (f) Interphase cells with an increased number of centrioles. The inset shows a magnified view of centrosomes. (g) Cell with multiple nuclei. (h) Interphase cell that displays a micronucleus next to a larger nucleus, as well as multiple centrosomes that are magnified in the inset. (i) Polyploid cell with a single nucleus containing more than 46 centromeres. (j) The dot plot shows a summary of the frequency of abnormal mitoses identified with the stains described in (a to h) in B cells from the same individual stimulated with pokeweed mitogen or infected with wild type M81 or M81/ΔZR. This analysis excludes the frequency of aneuploidy described in the sequel. Some of the obtained results included null values. Therefore, we applied an exact Wilcoxon signed rank test to compare the results.

Figure 2:
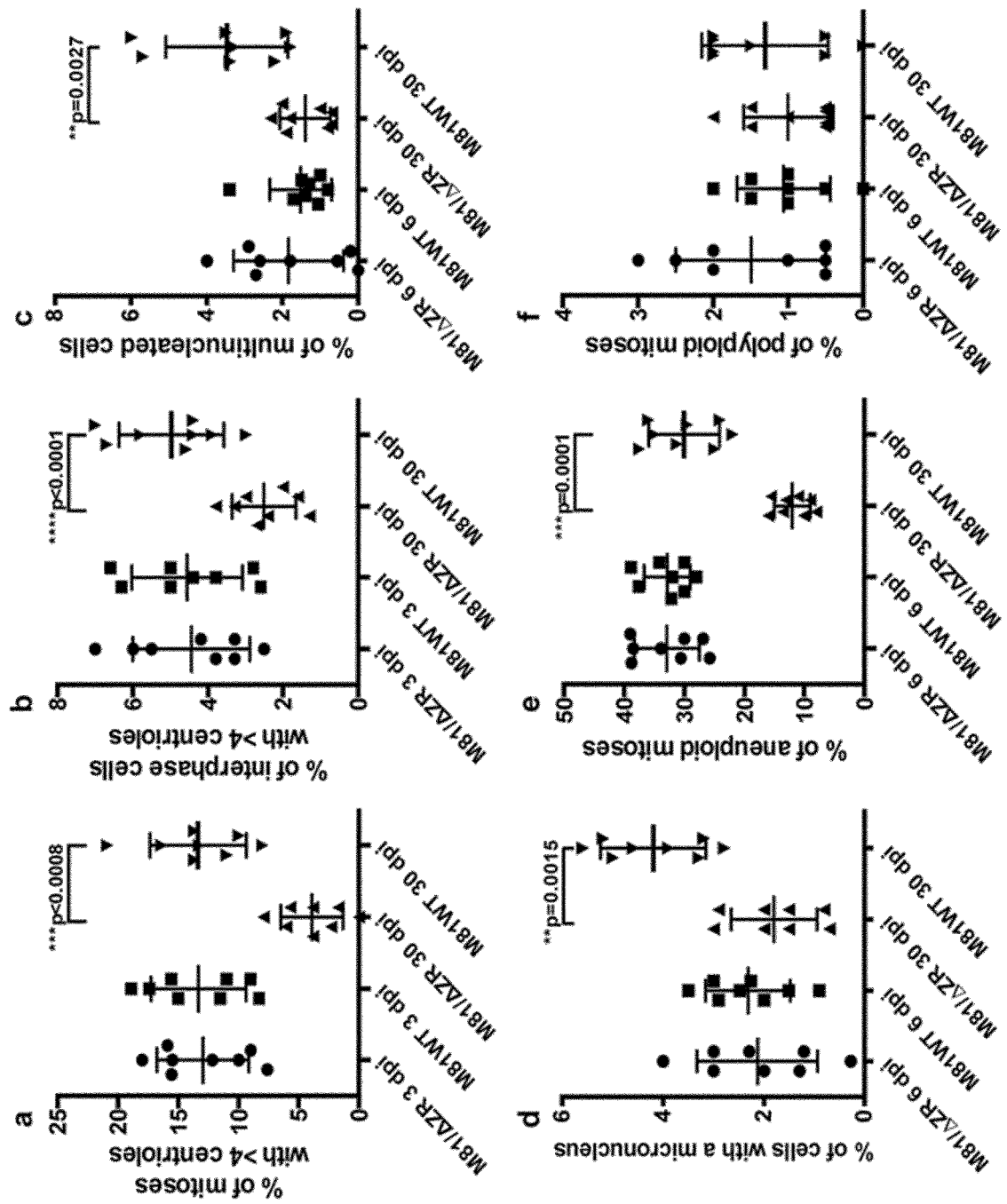

FIG. 2: Rate of chromosomal instability in cells transformed by wild type EBV (M81WT) or a replication-defective mutant (M81/ΔZR). We have analysed 8 sample pairs. Cells were analysed at day 3, 6 or 30 post-infection. Cells were cytospinned and stained with multiple markers. For each sample, at least 100 mitoses and 500 interphase cells were analysed. Independently, chromosomes were prepared to evaluate the rate of aneuploidy and for each of these samples at least 50 mitoses were analysed. The figure summarizes the frequency of bipolar mitoses organized around more than 4 centrioles (a), of interphase cells with more than 4 centrioles (b), of multinucleated cells (c), of cells carrying one or several micronuclei (d), of aneuploid mitoses (e), of polyploid mitoses (f). The graphs include the results of statistically significant paired-t tests performed on pairs of samples analysed at day 30 post-infection. dpi: days post-infection FIG. 3: B cells transformed by wild type EBV display a higher CIN rate than those transformed with a non-replicative mutant four weeks post-infection. Example of a M-FISH karyotype showing mitoses from a pair of transformed cell lines infected with wild type EBV (a), or with a replication-cell deficient mutant (b). (c) and (d) show 2 translocations found in 2 other cell lines transformed by wild type EBV.

Figure 4:
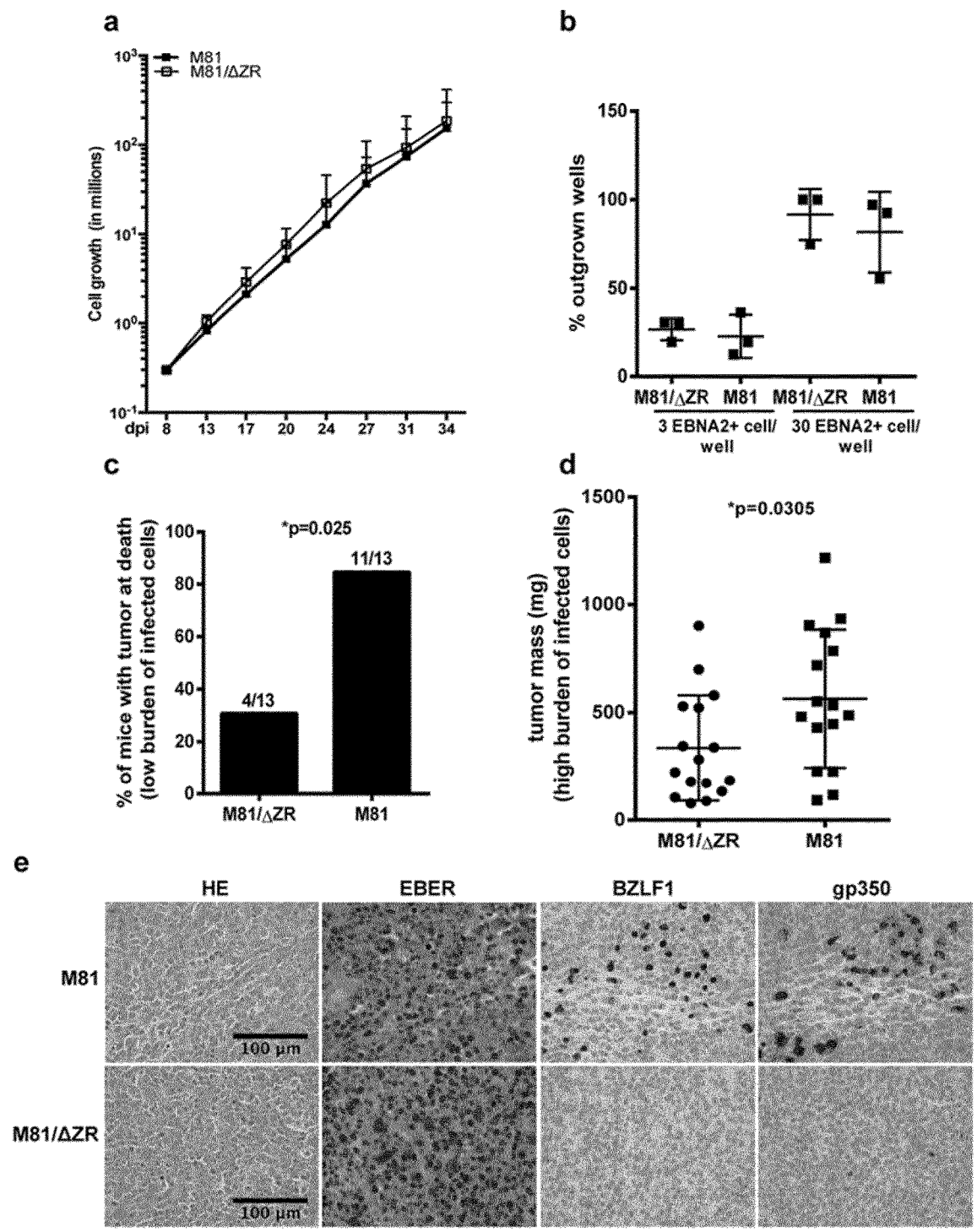

FIG. 4: B cells infected with wild type M81 induce tumours with a higher frequency in immunodeficient mice than B cells infected with the replication-deficient M81/ΔZR virus. B cells were exposed to M81 wild type and to the M81/ΔZR mutant and were injected intra-peritoneally to NSG mice or grown in vitro. (a) The graphs show cell growth of 7 independent B cell samples in vitro for a period of 34 days. We show the mean value with standard deviation. (b) Three of the samples described in (a) were seeded in 96 well cluster plates coated with feeder cells at a concentration of 3 or 30 EBNA2-positive cells per well. The dot plot shows the percentage of outgrown wells taken as a marker of transformation. (c) The graph shows the incidence of tumours in immunocompromised mice after injection of $4 \times 10^4$-infected B cells. The results obtained with wild type M81 and M81/ΔZR were assessed by an exact Mantel-Haenszel test with strata to take into account the variability due to the use of three infected primary B cell samples in this experiment. (d) The dot plot shows the tumour mass in 16 animal pairs that developed a tumour after injection of $4 \times 10^5$ B cells infected with M81 or M81/ΔZR. The results are analysed by an unpaired t-test. (e) Histological stainings showing the morphology of tumours that developed after injection of EBV-infected cells in immunocompromised mice (H&E stain), the expression pattern of the EBER non-coding RNAs, as well as of the BZLF1 and gp350 proteins. We show one example of a tumour that developed after infection with the wild type virus or after infection with the M81/ΔZR mutant. dpi: days post-infection.

Figure 5:
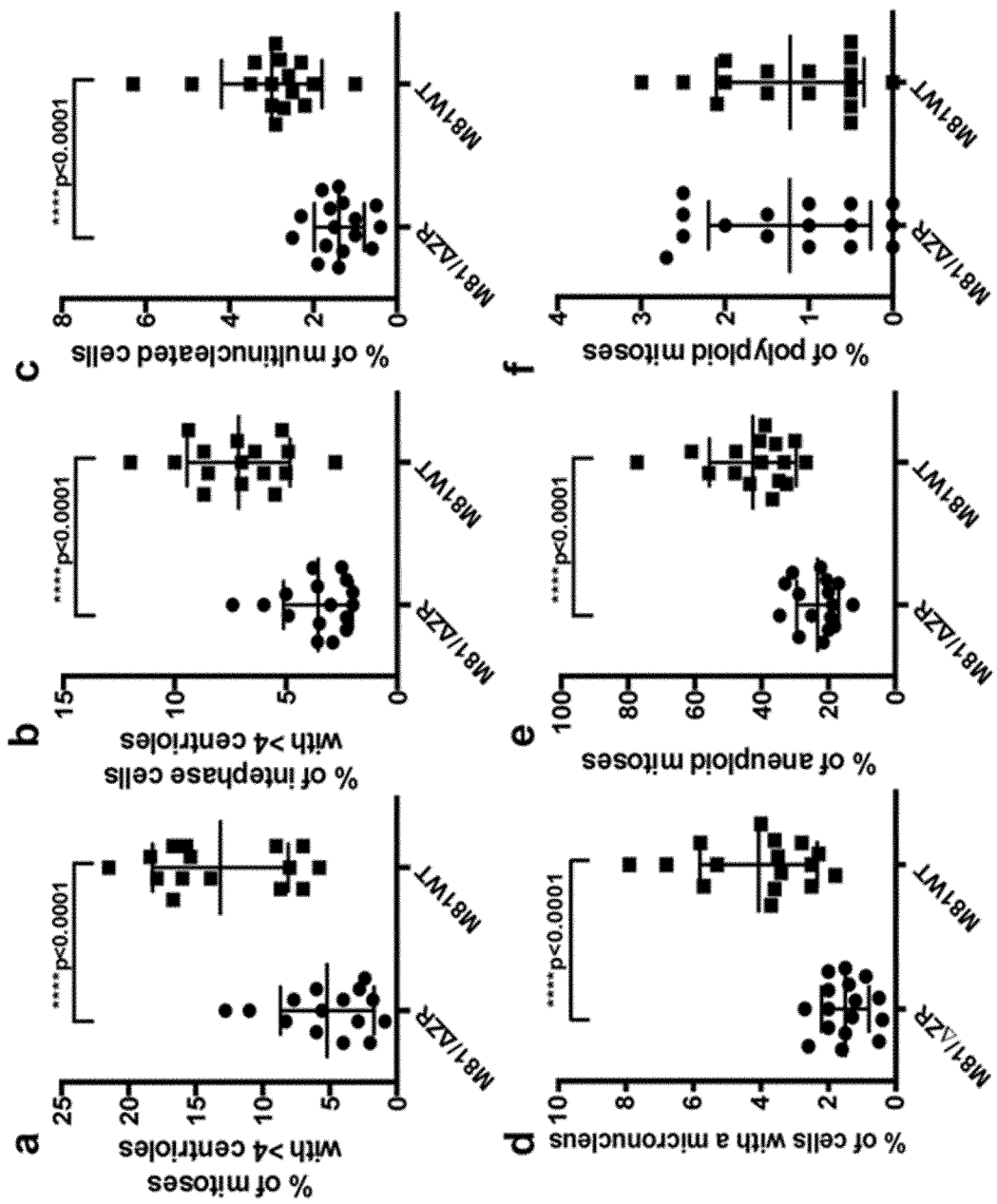

FIG. 5: Lymphoid tumours generated with wild type M81 exhibit a higher degree of CIN than those generated with a replication-defective M81/ΔZR mutant. 32 NSG mice were injected with $4 \times 10^5$ B cells infected with wild type M81 or the M81/ΔZR mutant. The dot plots summarize the frequency of bipolar mitoses organized around more than 4 centrioles (a), of interphase cells with more than 4 centrioles (b), of multinucleated cells (c), of cells carrying one or several micronuclei (d), of aneuploid mitoses (e), of polyploid mitoses (f). For each except in 2 samples, at least 100 mitoses and 500 interphase cells were analysed. The results were subjected to an unpaired t-test. See also FIG. 2 for a comparison with the results of in vitro infections.

Figure 6:
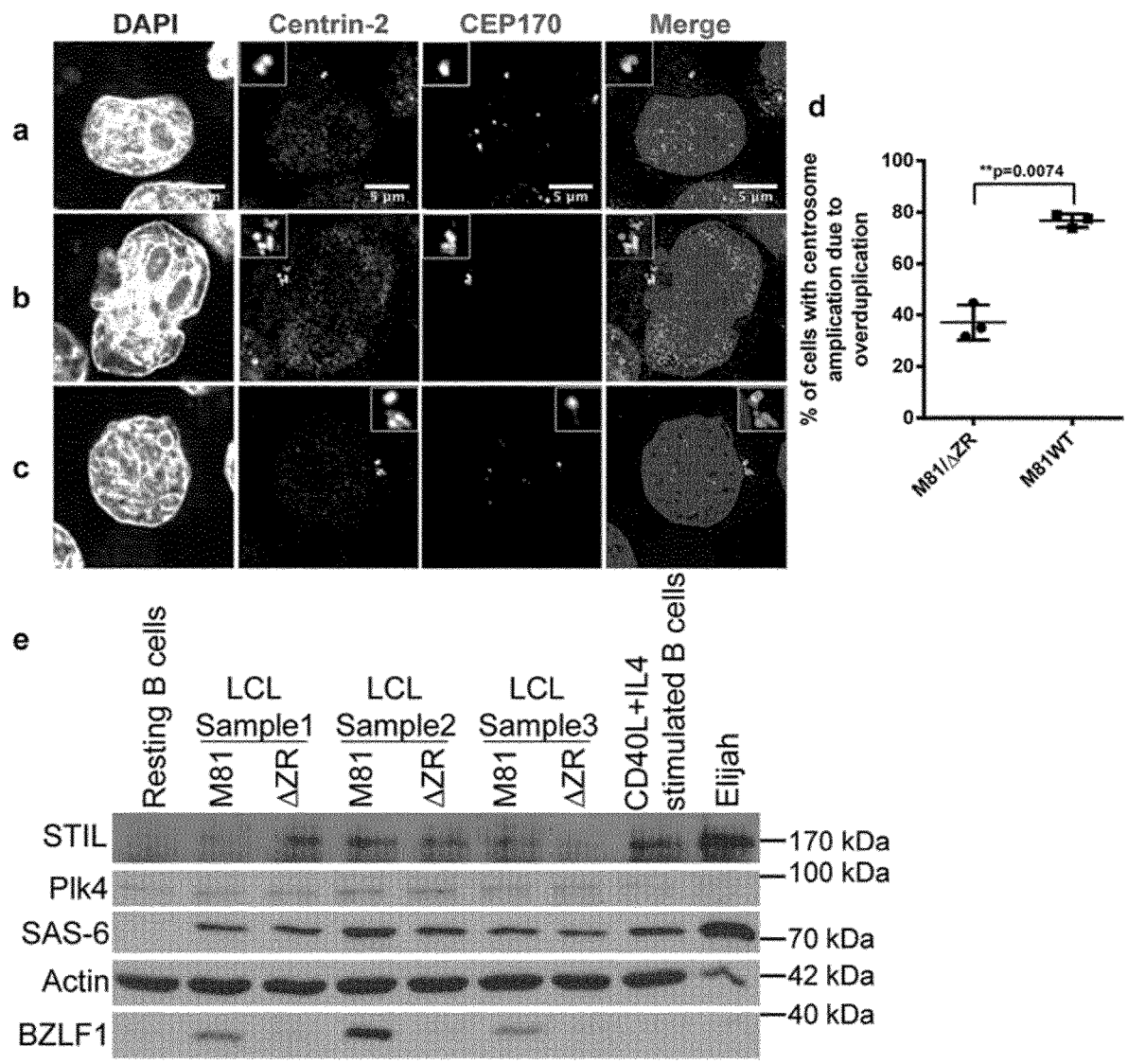

FIG. 6: Centrosome amplification in wild type EBV-infected cells mainly results from overduplication. LCLs infected with wild type virus were co-stained with antibodies specific to centrin and CEP170, 2 proteins that localize to the centrosome, and counter-stained with DAPI. (a) This infected cell shows two centrin-positive centrioles (green) but only one centriole (red) expresses CEP170. (b) Infected bi-nucleated cell with centrosome accumulation showing staining for CEP170 in approximately 50% of the centrioles. (c) Infected cell showing centrosome overduplication with only one CEP170-positive centriole and at least 4 centrin-positive centrioles. (d) This graph shows the proportion of the cells with centrosome amplification that arose through overduplication in cells infected with wild type M81 or with M81/ΔZR. The analysis was performed on 3 blood samples. (e) Immunoblots performed on 3 pairs of LCLs infected with either M81 or M81/ΔZR with antibodies specific to Plk4, Sas-6, STIL, actin or BZLF1. Non-infected resting B cells, B cells stimulated with CD40L and IL4, and the Burkitt's lymphoma cell line Elijah served as controls.

Figure 7:
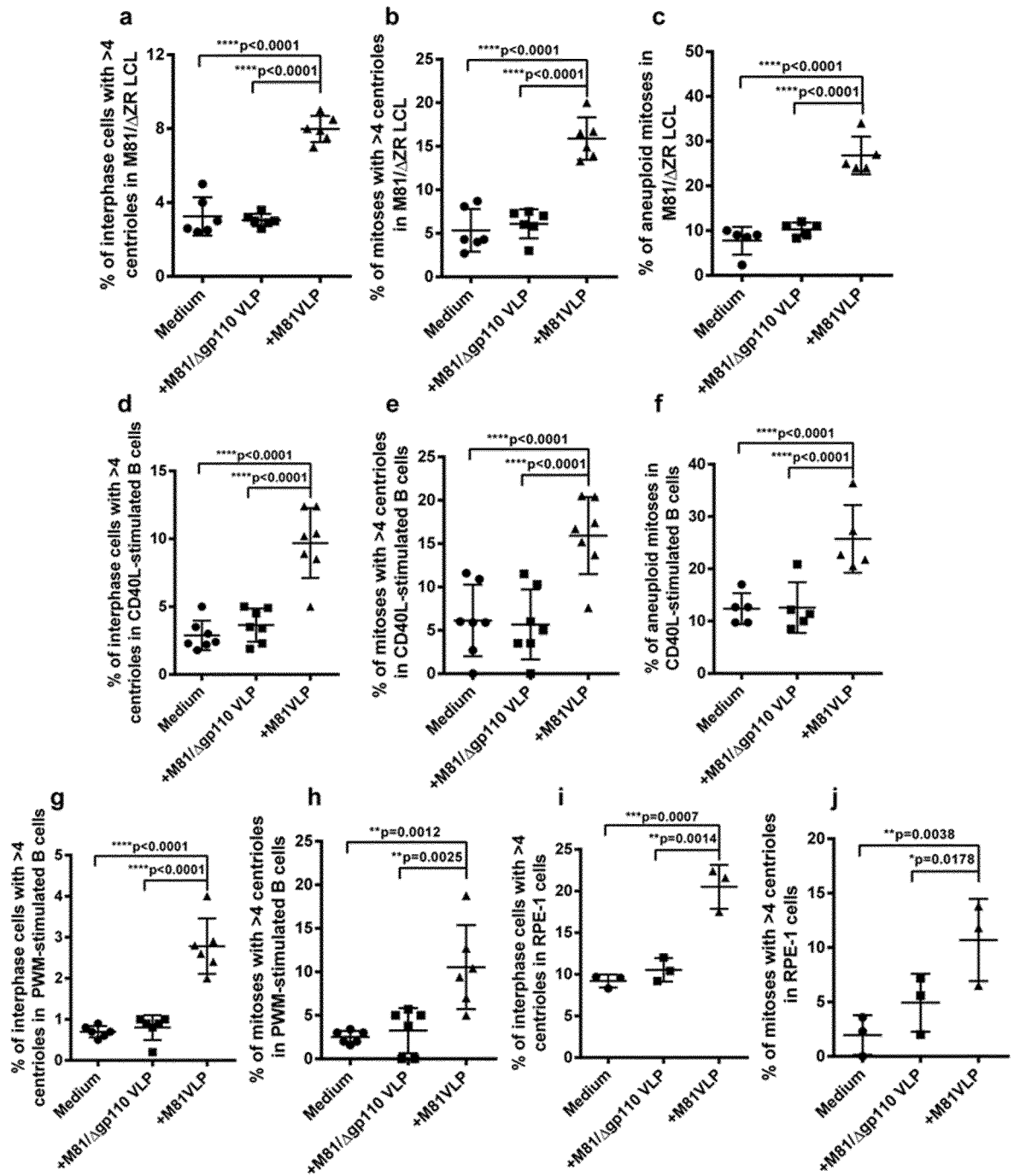

FIG. 7: Exposure of B cells transformed with M81/ΔZR, pokeweed mitogen-stimulated B cells, CD40 L-stimulated B cells and RPE-1 cells to virus-like particles leads to centriole amplification. The different cell populations were treated with M81 virus-like particles (VLP), with virus-like particles that cannot fuse with target cells (Δgp110 VLP), or with medium. The analysis was performed three days post-infection. For each sample, at least 100 mitoses and 500 interphase cells were examined. The dot plots show the frequency of interphase cells with centriole amplification, bipolar mitoses with an increased number of centrosomes or of aneuploid mitoses in (a, b and c) 6 B cell samples transformed by the M81/ΔZR mutant, in (d, e and f) 7 B cell samples stimulated with IL4 and CD40-L. We also quantified the percentage of interphase cells or of mitoses that displayed more than 4 centrioles in 6 B cell samples stimulated with pokeweed mitogen (g and h), and in RPE-1 cells subjected to 3 independent infections (i and j). We show the results of paired t-tests for the B cell samples and of an unpaired t-test for the RPE-1 cells.

Figure 8:
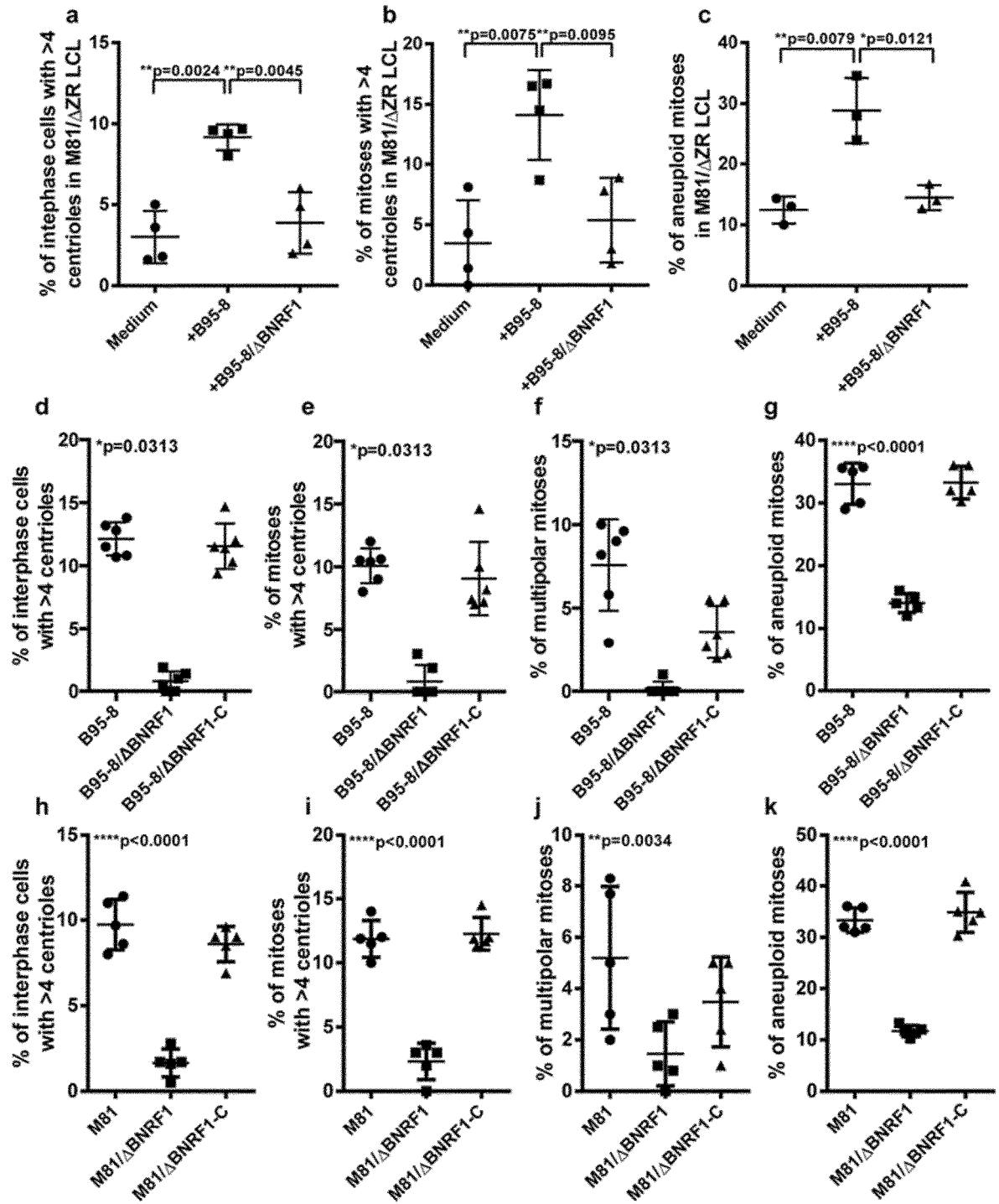

FIG. 8: B cells infected with Epstein-Barr viruses that lack BNRF1 show a markedly reduced rate of centrosome amplification and aneuploidy relative to wild type infection. (a to c) Rate of centrosomal amplification and aneuploidy in cells transformed by M81/ΔZR viruses and exposed to wild type B95-8 or B95-8/ΔBNRF1 virus. The analysis was performed 3 days after infection. These dot plots summarize the frequency of interphase cells with more than 4 centrioles (a), of bipolar mitoses organized around more than 4 centrioles (b), of aneuploid mitoses (c). The results were evaluated with a paired t-test. (d to g) LCLs from 5 independent blood samples were generated with wild type B95-8, a B95-8/ΔBNRF1 knock-out virus, or with a B95-8/ΔBNRF1 virus complemented with BNRF1 (ΔBNRF1-C). The dot plots show the frequency of interphase cells harbouring an increased number of centrioles (d), of bipolar mitoses organized around more than 4 centrioles (e), of multipolar mitoses (f), and of aneuploid mitoses (g). (h to k) Same experiments as (d to g) but performed with a BNRF1 knockout virus constructed on the basis of M81. For each sample, at least 100 mitoses and 500 interphase cells were examined. For (a) to (c) we give the results of paired t-tests; for (d) to (k) we applied an exact Wilcoxon signed rank test to compare the abnormality rate of B cells infected with ΔBNRF1 mutant with those of B cells infected with wild type or complemented virus. The p-values give the results of global mixed linear model analyses with random effect.

Figure 9:
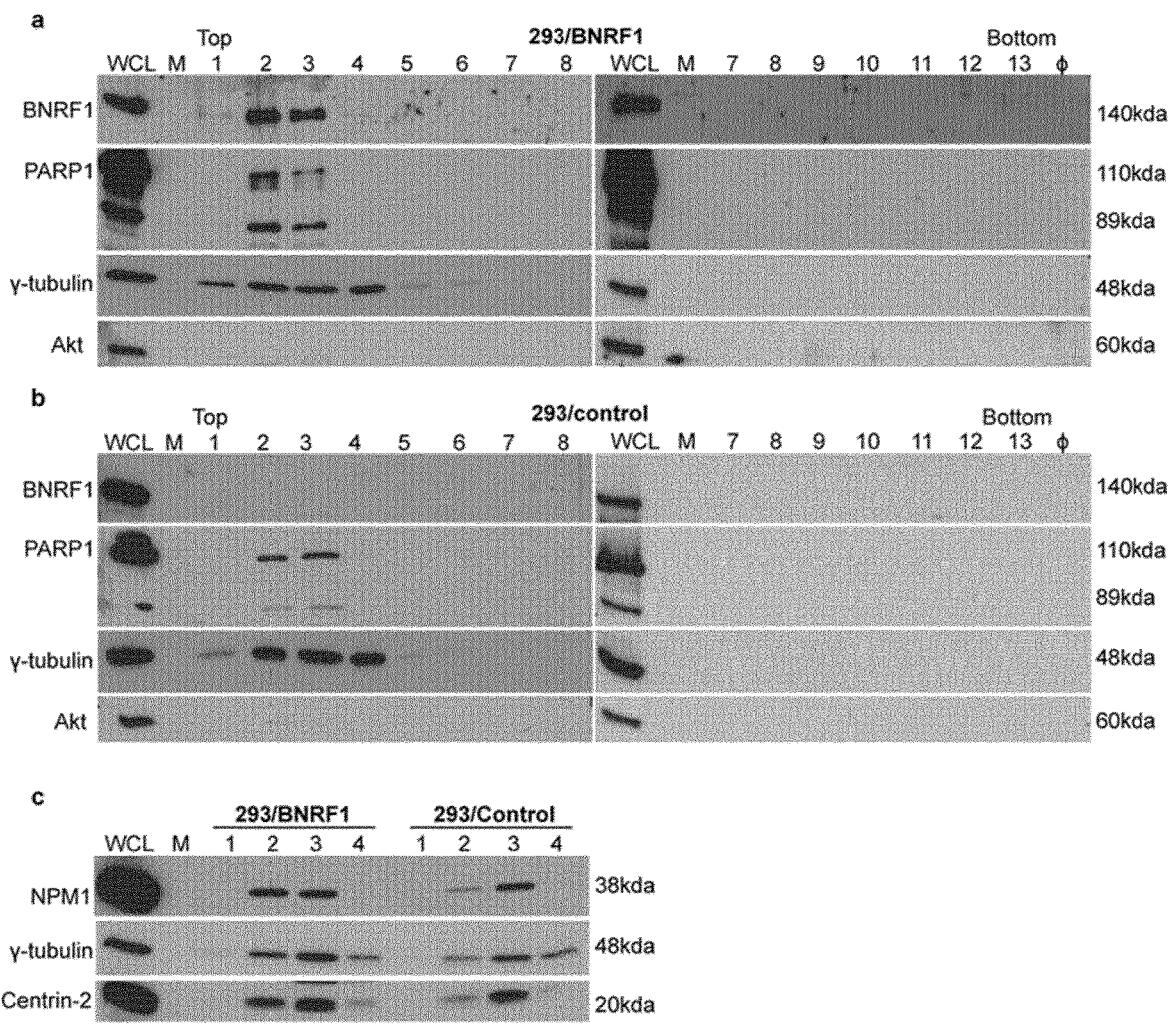

FIG. 9: BNRF1 is enriched in the centrosomal fraction 293 cells were subjected to BNRF1 overexpression. Cellular organelles were separated on a sucrose gradient after exclusion of the nuclei. We immunostained the consecutive fractions collected from this gradient with an antibody specific for gamma-tubulin to identify the centrosomal proteins and with an antibody specific to BNRF1. We also stained the extracts with antibodies specific to PARP1, a protein that localizes to the centrosome. The antibody specific to PARP1 identifies a full size protein as well as a smaller form of the protein generated by caspase 3 cleavage. Finally, we stained the blots with an antibody specific to Akt to detect contaminations from free cytoplasmic proteins. The latter staining was performed to ensure that the gradient had not been contaminated with free cytoplasmic proteins. Non-purified whole cell extracts (WCL) of cells with BNRF1 overexpression were included as a positive control and ϕ indicates wells without samples. (a) shows the fractions collected from cells that expressed BNRF1, (b) shows the fractions collected from cells transfected with a empty control plasmid. (c) The fractions containing the centrosomal proteins and described in (a) and (b) were immunoblot.

Figure 10:
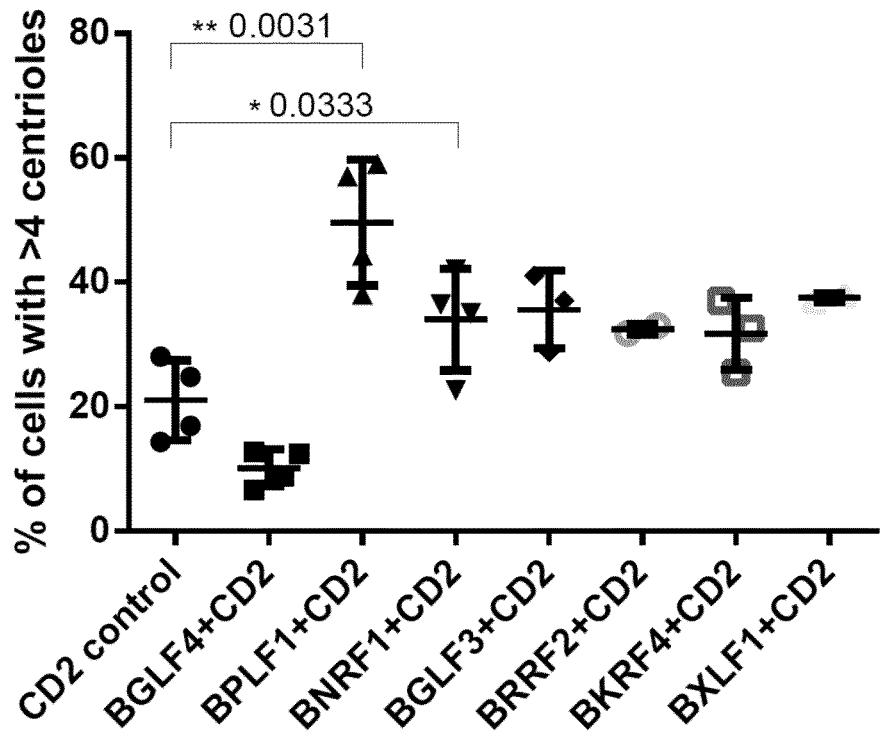
Figure 10:
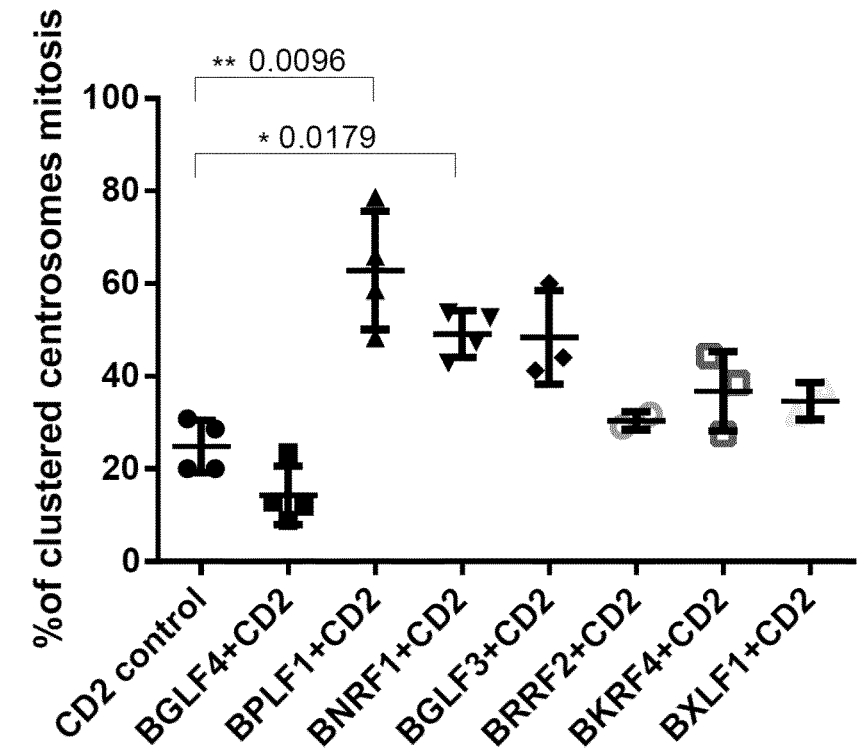
Figure 10:
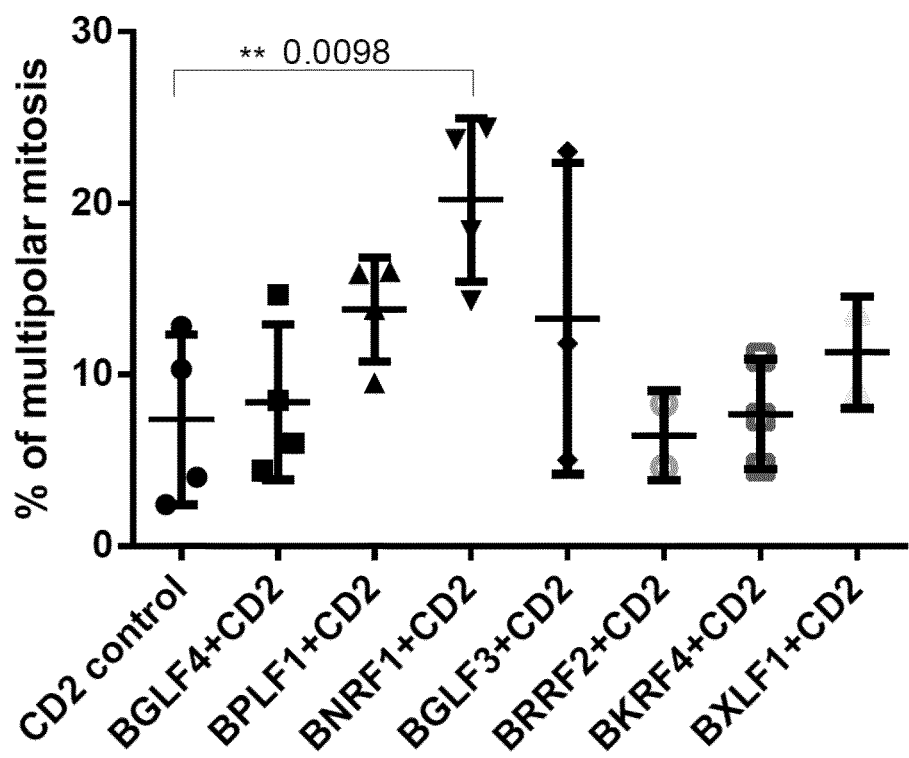

FIG. 10: EBV proteins inducing chromosomal instability 293 HEK cells were transfected with expression plasmids for the indicated EBV genes. Indicators of chromosomal instability were determined. (a) Combined HEK293 transfection interphase; y-axis: fraction of cells with >4 centrioles (%); (b) Combined HEK293 transfection centrosome clustering; y-axis: fraction of cells with clustered centrosome mitosis (%); (c) Combined HEK293 transfection multipolarity; y-axis: fraction of multipolar mitosis (%).

The following Examples shall merely illustrate the invention. They shall not be construed, whatsoever, to limit the scope of the invention.

EXAMPLE 1: METHODS

Ethics Statement

All human primary B cells used were isolated from anonymous buffy-coats purchased from the blood bank of the University of Heidelberg. No ethical approval is required. All animal experiments were performed in strict accordance with German animal protection law (TierSchG) and were approved by the federal veterinary office at the Regierungspräsidium Karlsruhe, Germany (Approval number G156-12). The mice were housed in the class II containment laboratories of the German Cancer Research Centre and handled in accordance with good animal practice with the aim of minimizing animal suffering and reducing mice usage as defined by Federation of European Laboratory Animal Science Associations (FELASA) and the Society for Laboratory Animal Science (GV-SOLAS).

Cell Lines, Primary Cells, Viruses

The 293 cell line is a neuro-endocrine cell line obtained by transformation of embryonic epithelial kidney cells with adenovirus (ATCC: CRL-1573). HeLa is a human cervix adenocarcinoma cell line (ATCC: CLL-2) that is infected with papillomavirus type 18. HeLa Kyoto mEGFP-alpha-tubulin/H2B-mCherry cell line is a derivate thereof that stably expresses the mEGFP-alpha-tubulin and H2B-mCherry protein fusions (Held M, et al., Nature methods 7, 747-754 (2010)). RPE-1 is a human epithelial cell line immortalized with hTERT (ATCC: CRL-4000). RPE-1/centrin-1-GFP is a cell line that constitutively expresses a centrin-1-GFP fusion protein (Yang Z, et al., Nature cell biology 10, 748-751 (2008)). U2OS is a cell line derived from a moderately differentiated sarcoma of the tibia (ATCC: HTB-96). Peripheral blood mononuclear cells from buffy coats purchased from the blood bank in Heidelberg were purified on a Ficoll cushion and CD19-positive primary B-lymphocytes were isolated using M-450 CD19 (Pan B) Dynabeads (Dynal) and were detached using Detachabead (Dynal). WI38 are primary human lung embryonic fibroblasts (ATCC: CCL-75). All cells were routinely cultured in RPMI-1640 medium (Invitrogen) supplemented with 10% fetal bovine serum (FBS)(Biochrom), and primary B cells were supplemented with 20% FBS until the establishment of LCLs. HeLa Kyoto mEGFP-alpha-tubulin/H2B-mCherry cells were supplemented with 0.5 µg/ml puromycin and 500 µg/ml G418. The EBV producer cells used in this study (M81, M81/ΔZR, B95-8, B95-8/ΔBNRF1, B95-8/ΔBFLF1ΔBFRF1ΔBBRF1ΔBALF4 (VLP with gp110 deletion), B95-8/ΔBFLF1ΔBFRF1ΔBBRF1 (VLP)) have previously been described and were established by stable transfection of EBV-BACs into 293 cells supplemented with 100 µg/ml hygromycin (Lin X, et al., PLoS pathogens 11, e1005344 (2015); Tsai M H, et al., Cell reports 5, 458-470 (2013); Pavlova S, et al., Journal of virology 87, 2011-2022 (2013); Neuhierl B, et al., Journal of virology 83, 4616-4623 (2009)). The VLP-producing mutants and the ΔBNRF1 mutant are also available on the basis of the M81 strain. They were constructed exactly as their B95-8 homologues. M81/ΔZR lacks the BZLF1 and BRLF1 transactivators that initiate lytic replication and therefore it is unable to replicate, B95-8/ΔBNRF1 and M81/ΔBNRF1 lack the BNRF1 tegument protein.

Plasmids

The BZLF1 (p509), BALF4 (pRA), and BNRF1 (B056) expression plasmids were previously described (Feederle R, et al., Journal of virology 80, 9435-9443 (2006)). We screened a library of 66 EBV proteins driven from a CMV promoter (Adhikary D, et al, PLoS One 2, e583 (2007)). An expression plasmid that encodes a cytoplasmic-truncated version of rat CD2 (B673) was constructed in pcDNA3.1. We also cloned the BNRF1 gene into a tetracycline-inducible plasmid, containing a minimal CMV promoter controlled by TetO operator, a tetracycline transactivator protein (Tet-On) driven by CAG promoter, the origin of plasmid replication derived from B95-8 strain, and a puromycin resistance cassette driven by a SV40 promoter (B1439) (Bornkamm G W, et al., Nucleic acids research 33, e137 (2005)). The parental vector without insert served as a negative control.

Transfections

All the transfection experiments were performed with the liposome-based transfectant Metafectene (Biontex) following the manufacturer's instruction.

Virus Production 293 cells stably transfected with recombinant EBV-BACs were transfected with expression plasmids encoding BZLF1 (p509) and BALF4 (pRA) to induce lytic replication, except for the production of VLPs that lack gp110 in which case only the BZLF1-encoding plasmid was transfected. Transfection of a plasmid that encodes the BNRF1 protein (B056) in a producer cell line that stably carries the ΔBNRF1 virus led to trans-complementation as described previously (Feederle R, et al., Journal of virology 80, 9435-9443 (2006)). Three days after transfection, virus supernatants were collected and filtered through a 0.4 µm filter.

B Cell Stimulation with Mitogens or CD40-Ligand

Freshly isolated CD19+ primary B cells were cultured with 15 µg/ml of pokeweed mitogen (PWM) (L9379, Sigma-Aldrich) or cultured on a 90Gy-γ-irradiated CD40-ligand feeder cell layer in the presence of 25 ng/ml recombinant human IL4 (PeproTech, Germany). Cells were subjected to cytospins or chromosomal analyses 3 days after the inception of stimulation.

Giemsa Staining

Cells were treated with 0.075 µg/ml colchicine (Sigma-Aldrich C3915) for two hours to induce metaphase arrest and allow preparation of metaphase spreads. After 3 washings with PBS, the cells were incubated in 75 mM KCl hypotonic buffer for 10 min at 37° C. and fixed in methanol: glacial acetic acid (3:1), dropped onto cold glass slides and stained with 5% Giemsa (Carl Roth GmbH T862.1) in water. Digital images of metaphase were captured using DM2500 (Leica, Wetzlar, Germany) microscope equipped with a DFC300 FX (Leica, Cambridge, UK) camera and subjected to karyotyping. We analyzed a minimum of 50 mitoses per sample.

Multiplex Fluorescence In Situ Hybridization (M-FISH).

M-FISH was performed as described by Geigl et al., Nature protocols 1, 1172-1184 (2006). Briefly, seven pools of flow-sorted human whole chromosome painting probes were amplified and directly labeled with seven different fluorochromes (DEAC, FITC, Cy3, Cy3.5, Cy5, Cy5.5, and Cy7) using degenerated oligonucleotides and PCR (DOP-PCR). Metaphase chromosomes immobilized on glass slides were denatured in 70% formamide/2×SSC pH 7.0 at 72° C. for 2 minutes followed by dehydration in increasingly pure ethanol series. The hybridization mixture contained combinatorially labeled painting probes, an excess of unlabeled cot1 DNA, 50% formamide, 2×SSC, and 15% dextran sulfate. It was denatured for 7 minutes at 75° C., pre-annealed at 37° C. for 20 minutes and hybridized at 37° C. to the denaturated metaphase preparations. After 48 hours, the slides were washed in 2×SSC at room temperature trice for 5 minutes, followed by two washes in 0.2×SSC/0.2% Tween-20 at 56° C. for 7 minutes each. Metaphase spreads were counterstained with 4.6-diamidino-2-phenylindole (DAPI) and covered with antifade solution. Metaphase spreads were recorded using a DM RXA epifluorescence microscope (Leica Microsystems, Bensheim, Germany) equipped with a Sensys CCD camera (Photometrics, Tucson, Ariz.). Camera and microscope are controlled by the Leica Q-FISH software and the images were processed on the basis of the Leica MCK software and presented as multicolor karyograms (Leica Microsystems Imaging solutions, Cambridge, United Kingdom). We analysed between 15 and 20 metaphases for each sample.

Analysis of the Mitotic Spindle

Cells were washed 3 times and re-suspended in PBS-3% FBS. The single cell suspension was then loaded on to Shandon cytospin chambers with slides (Thermo Scientifics) and spun at 2000 rpm for 10 minutes. The cytospinned cells were air-dried, fixed in pure methanol at −20° C. for 8 mins and briefly washed in PBS two times at room temperature for 5 mins each. The cells were blocked in PBS-3% BSA for 30 min, incubated with the first antibody for 1.5 hr, washed in PBS three times 5 min, incubated with a secondary antibody conjugated to Cy-3, Cy-5, or Alexa488 for 1.5 hr. Slides were again washed three times in PBS and mounted in ProLong Gold antifade reagent including the DAPI fluorochrome (Life technologies). In each sample, at least 100 mitoses and 500 interphase cells were examined. Pictures of stained cells were taken with a camera attached to a DM2500 fluorescence microscope (Leica) or with a confocal microscope (Zeiss LSM700 run on ZEN2009).

Cell Cycle Synchronization

HeLa Kyoto mEGFP-alpha-tubulin/H2B-mCherry cells (or other cells applied in the study) were treated with 2 mM thymidine for 16 hours, released for 8 hrs and again blocked for 16 hrs to obtain a double thymidine block.

Life Cell Imaging

We performed life cell imaging on HeLa Kyoto mEGFP-alpha-tubulin/H2B-mCherry cells that were treated for 72 hours with either medium, viruses or virus-like particles. During this treatment, the cells were synchronized in the G1 phase by a double thymidine block. After the second release of the thymidine block, $2.5*10^5$ cells per well were seeded in Ibidi μ-slide 8 well plate or Lab-Tek II chambered coverglass (8 chambers). The cells were monitored by a 20×/0.4 air objective on an inverted microscope (Zeiss motorized Observer.Z1) connected to a color CCD camera AxioCam ICc 3 at 5% CO2 and 37° C. incubator. LED module Colibri.2 with 470 nm for GFP and 590 nm for mCherry were used for fluorochrome excitation. Multipoint images were taken with 3-8 z-stacks to cover a range of 6 to 8 μm every 5 min for 5-15 hours with the cell Zeiss Zen blue software. Maximum intensity projection of the fluorescent channels was performed by ImageJ software to create 8-bit RGB TIFF files and movies.

B Cell Infections and In Vitro Transformation Experiments

B cells purified from peripheral blood of different healthy donors were exposed to viruses for two hours at a multiplicity of infection (MOI) of 20 virus genomes, as defined by qPCR per target cell as described previously (Feederle R, et al., Journal of virology 80, 9435-9443 (2006)). Infected cells were washed once with PBS and plated in cluster plates in RPMI supplemented with 20% FBS. For transformation assays, we first determined the percentage of EBNA2-positive cells within the infected sample using immunostaining 3 days post-infection. Infected cell populations were seeded in 96-U-well plates coated with $10^3$ gamma-irradiated WI38 feeder cells at a concentration of 3 or 30 EBNA2-positive cells per well. Non-infected B cells served as a negative control. The outgrowth of lymphoblastoid cell clones (LCLs) was monitored at 30 dpi. In parallel we also monitored cell growth in batch culture by counting the cell numbers in the infected populations twice per week.

Screening of the EBV Library

The EBV protein expression library was used for transient transfection into 293 cells. To identify the transfected cells, we co-transfected a plasmid encoding a cytoplasmic-truncated rat CD2 that is expressed as a surface marker.

Transformation Experiments in Immunocompromised Mice

We isolated human CD19+ B cells from buffy coats and exposed them to M81 or M81/ΔZR in vitro for 2 hours at room temperature under constant agitation at a MOI sufficient to generate 20% of EBNA2-positive cells (Lin X, et al., PLoS pathogens 11, e1005344 (2015)). We used 3 different buffy coats to infect 26 mice. The infected cells were collected by centrifugation and washed twice with PBS. $2×10^5$ or $2×10^6$ primary B cells exposed to the virus, equivalent to $4×10^4$ and $4×10^5$ EBV-infected cells, respectively, were injected intraperitoneally into NSG mice. We used 3 different buffy coats to infect 26 mice with $4×10^4$ EBV-infected cells and 5 different buffy coats to infect 32 mice with $4×10^5$ EBV-infected cells. The mice were euthanized at 6 weeks post-injection when clinical symptoms appeared (apathy, food refusal, ruffled hair, weight loss, palpable tumour). After careful autopsy, the organs were subjected to macroscopic and microscopic investigation, including H&E staining and immunohistochemistry. We also generated single cell suspensions from the tumour mass that were cultured overnight in RPMI-20% FBS overnight and used to generate metaphase spreads or cytospinned and subjected to immunofluorescence staining.

Immunohistochemistry

Organs from the euthanized mice were fixed in 10% formalin and embedded in paraffin. 3 μm thin sections were prepared and immunostained after antigen retrieval (10 mM sodium citrate, 0.05% Tween 20, pH 6.0; 98° C. for 40 minutes). Bound antibodies were visualized with the Envision™+ Dual link system-HRP (Dako). Pictures were taken with a camera attached to a light microscope (Axioplan, Zeiss).

Western Blots

Proteins were extracted with a standard lysis buffer (150 mM NaCl, 0.5% NP-40, 1% Sodium deoxycholat, 0.1% SDS, 5 mM EDTA, 20 mM Tris-HCl pH7.5, proteinase inhibitor cocktail (Roche)) for 15 min on ice followed by sonication to shear the genomic DNA. Up to 20 μg of proteins denatured in Laemmli buffer for 5 min at 95° C. were separated on SDS-polyacrylamide gels and electroblotted onto a nitrocellulose membrane (Hybond C, Amersham). After pre-incubation of the blot in 3% BSA PBST (PBS with 0.2% Tween 20), the antibody against the target protein was added and incubated at room temperature for 1 hr. After extensive washings in PBST, the blot was incubated for 1 hr with secondary antibodies. Bound antibodies were revealed using the ECL detection reagent (Pierce).

Antibodies

We used primary mouse monoclonal antibodies against alpha-tubulin (Sigma-Aldrich T5168), gamma-tubulin (Sigma-Aldrich T6557), Plk1 (Santa Cruz sc-17783), SAS-6 (Santa Cruz sc-81431), centrin-2 (Millipore 04-1624), NPM1 (Zymed 32-5200), beta actin (Dianova DLN-07273); rabbit polyclonal antibodies against centrin-2 (Santa Cruz sc-27793-R), CEP170 (Abcam ab72505), phospho-Histone H3 (PH3, Cell signaling 9716), STIL (Bethyl Laboratories A302-442A), PARP1 (Cell signaling 9542S), Akt (Cell signalling); human polyclonal anti centromere (CREST, Antibodies Incorporated 15-235-F). The mouse monoclonal antibodies against BZLF1 (clone BZ.1), gp350 (clone OT6), LMP1 (clone CS1-4), rat CD2 (clone OX34) were collected from hybridoma supernatants. Rabbit antiserum against BNRF1 protein was produced as described before (Feederle R, et al., Journal of virology 80, 9435-9443 (2006)). The mouse antibody against human Plk4 was raised against a synthetic peptide (amino acid 567-579 of human Plk4) (Cizmecioglu O, et al. Cep152 acts as a scaffold for recruitment of Plk4 and CPAP to the centrosome. The Journal of cell biology 191, 731-739 (2010)). The secondary antibodies applied for immunofluorescence staining were goat anti-mouse coupled to Alexa488 (Invitrogen A11029) or Cy3 (Dianova 115-165-146), anti-rabbit coupled to Alexa488 (Invitrogen A11008) or Cy3 (Dianova 111-165-144). Horseradish peroxidase-coupled goat anti-mouse or rabbit antibodies (Promega) were applied as secondary antibodies for Western blot analyses.

Centrosome Isolation 293 cells were stably transfected with the tetracycline-inducible plasmid carrying BNRF1 (B1439) or its control (B484) using puromycin selection (2 µg/ml). Single cell colonies that displayed an induction rate of at least 90% were selected for further experiments. These cells were induced with 0.025 µg/ml doxycycline for 1.5 days, then treated with nocodazole (10 µg/ml; Merck Millipore) and cytochalasin B (5 µg/ml; Merck Millipore) for 90 min. The cells were re-suspended in ice-cold PBS and the pellets were collected by centrifugation. After washing with 0.1×PBS, 8% sucrose, the pellets were lysed by adding 8 ml of lysis buffer (1 mM Tris-HCl pH 8.0, 0.5% Nonidet P-40, 0.5 mM $MgCl_2$, 0.1% β-mercaptoethanol, 1× proteinase inhibitor cocktail (Roche)) per 15 cm plate, inverted several times and put on ice for 5 min. The lysates were spun at 2,500×g for 10 min at 4° C. to pellet down the nuclei, aggregates, and intact cells. The clarified supernatants were carefully collected and further filtered through 40 µm cell strainers. The lysates were adjusted to 1×PE (10 mM Pipes, 1 mM ETDA) by using 50×PE buffer (500 mM Pipes, 50 mM ETDA, pH 7.2), incubated with 1 µg/ml DNaseI on ice for 15 min, loaded onto a 50% (weight/weight) sucrose cushion prepared in gradient buffer (1×PE buffer, 0.1% Nonidet P-40, 0.1% β-mercaptoethanol), spun at 4° C. for 20 min at 12,000 rpm with a SW40Ti rotor without break. After centrifugation, 7 ml of supernatant were visible atop of the cushion. We discarded the first 5 ml of supernatant and collected the remaining 2 ml, together with first ml of sucrose gradient. These combined fractions were well mixed and loaded onto a discontinuous sucrose gradient made from bottom to top of 1 ml 70% (weight/weight) sucrose, 1.5 ml 50% (weight/weight) sucrose, 2.5 ml 40% (weight/weight) sucrose prepared in gradient buffer. The gradients were spun at 34,000 rpm at 4° C. for 90 min without break. After centrifugation, the upper supernatant atop of the sucrose gradient was discarded and the sucrose fractions were collected in 450 µl aliquots from the bottom to the top. The organelles present in each fraction were recovered by mixing 100 µl of each fraction with 1.2 ml 1×PE buffer and centrifuging them at 21,000×g at 4° C. for 25 min. The supernatants from each these preparations were carefully removed, the pellets were lysed using SDS sample buffer and subjected to SDS page and Western blot analyses.

Statistical Analysis

We applied paired student t-tests to the data collected from the infection of multiple primary B cell samples or of LCLs established from the same blood sample with 2 different types of viruses. The results collected from independent infection experiments of cell lines with 2 different viruses were analysed with a paired student t-test. We used a mixed linear model with random effect to donor to globally analyse the effects of exposure to different viruses or of mock-infection, combined to Bonferroni-adjusted pairwise comparisons. The calculations were performed with SAS 9.3. Infection experiments that included negative results were analysed with a Wilcoxon signed rank test with calculations performed with R. The results of the animal experiments in which multiple B cell populations were used for infections were evaluated with an exact Mantel-Haenszel test with strata and the calculations performed with R. The data gathered by life cell imaging over time were, as expected, right-skewed and were log-transformed. They were then subjected to an ANOVA test performed on SAS 9.3, followed by Bonferroni-adjusted pairwise comparisons.

EXAMPLE 2: EBV REPLICATION IN INFECTED B CELLS INCREASES CHROMOSOMAL INSTABILITY

We addressed the contribution of EBV lytic replication to the neoplastic process induced by the virus by comparing B cells infected with the highly replicating strain M81 that was isolated from a NPC and a replication-deficient mutant thereof (M81/ΔZR). We began our investigations by comparing the mitoses of cells either stimulated with pokeweed mitogen (PWM) or infected with either M81 or M81/ΔZR. At day 3 post-treatment, dividing PWM-stimulated B cells displayed typical mitotic figures at different stages, with equal distribution of chromosomes in daughter cells. In contrast, many dividing cells infected with either type of virus exhibited abnormal mitoses. Some mitoses were multipolar, others were bipolar but arranged around multiple centrioles (FIG. 1a, b, FIG. 2a). Some mitoses contained non-aligned chromosomes and some anaphases showed images of chromosome lagging (FIG. 1c, d). We also found asymmetrical anaphases in which the chromosome sets were imperfectly distributed (FIG. 1e). Altogether, this set of experiments showed that 15 to 42% of mitoses in infected cells displayed an abnormal organization, which compares to 0 to 6% after PWM stimulation (FIG. 1f). Moreover, 2.2 to 7% of interphase cells showed more than 4 centrioles in the virus-infected population (FIG. 1f, FIG. 2b).

Six days after infection, cells with abnormal nuclei became also visible. Some cells displayed 2 to 4 equally sized nuclei, others carried one or several micronuclei coexisting with a nucleus of approximately normal size (FIG. 1g, h, FIG. 2c, d). Other cells contained a single large nucleus that proved to be polyploid after staining with serum from CREST patients that evidences the number of centromeres (FIG. 1i). Giemsa staining of mitotic plates showed that 25 to 40% of cells in these samples were aneuploid and up to 3% were polyploid (FIG. 2e, f). We performed M-FISH on 3 sample pairs 6 days after infection with M81 or M81/ΔZR. This analysis confirmed the high level of aneuploidy in cells infected with either type of viruses (average 29.2%), but also the presence of rare cells with chromosome deletions (2/120) or translocations (3/120). However, none of these abnormalities were clonal, i.e. found in more than 2 mitoses of the same sample. At this time point, PWM-stimulated cells had died and could not be analysed. We continued to monitor the cells infected with M81 and M81/ΔZR until day 30 post-infection, when lytic replication begins in cells infected with wild type viruses. By then, both centrosomal amplification and aneuploidy rates had been reduced by approximately 3-fold in cells infected with M81/ΔZR, implying that the conditions that led to their appearance vanished over time (FIGS. 2a, b and e). The investigation of cells infected with M81/ΔZR at day 3, 6, 15 and 30 post-infection showed a regular decrease in the rate of centrosome amplification. In contrast, although cells infected with the wild type virus showed an initial decrease in the percentage of cells showing centrosome amplification, this rate sharply re-increased at day 30 when infected cells start to replicate (FIG. 2a, b).

Figure 3:
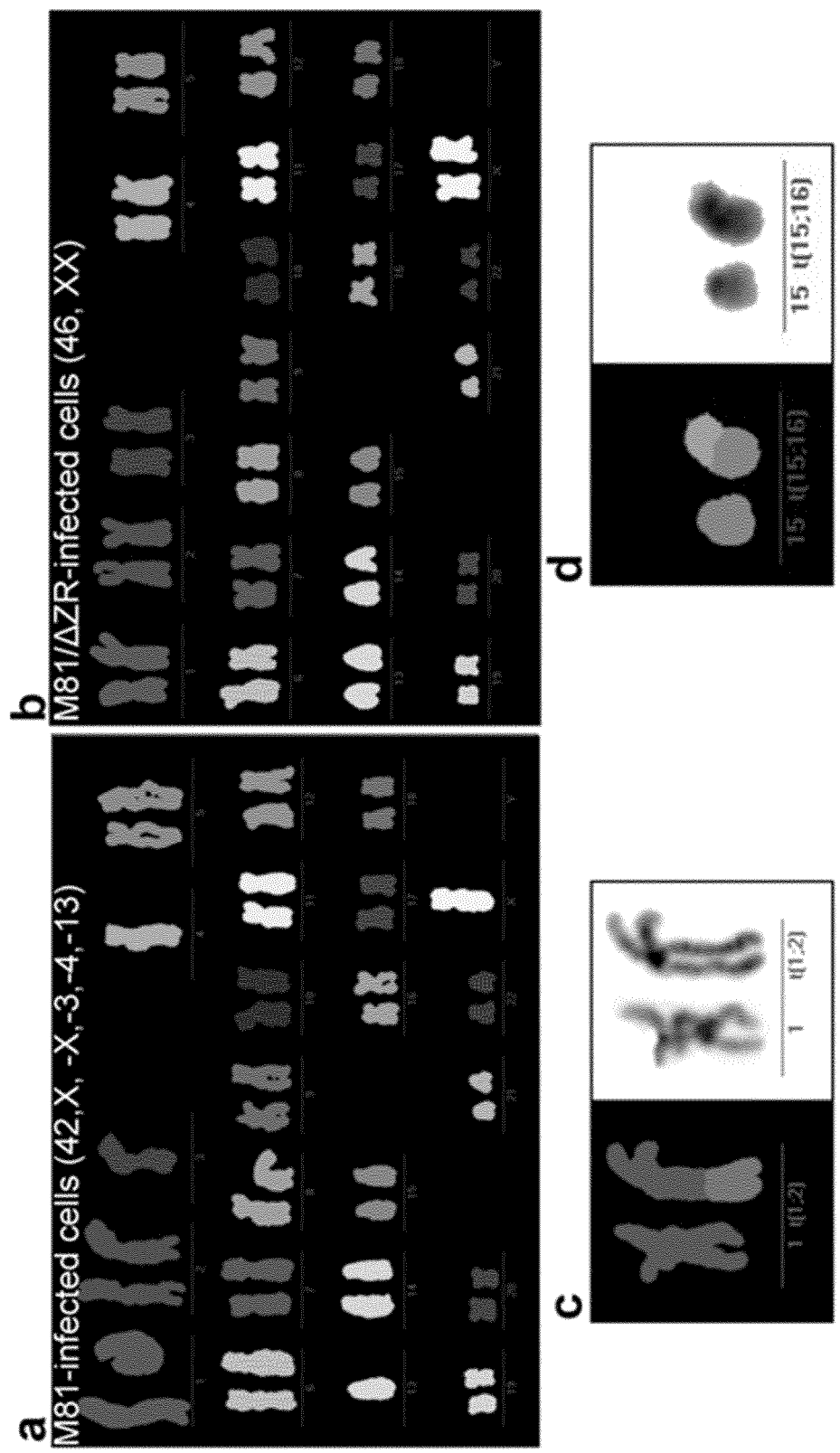

M-FISH karyotyping of 4 sample pairs confirmed the much higher level of aneuploidy in cells infected with the wild type virus than in those infected with the replication-deficient mutant after 30 days of infection (average 38.75% versus 9%) (FIG. 3). The former cells also more frequently carried structural rearrangements, including chromosome deletions and translocations. Two of these four samples infected with wild type but none of those infected with M81/ΔZR showed a clonal abnormality, defined by more than 2 identical abnormal mitoses for structural abnormalities and more than 3 mitoses for chromosome loss. One B cell sample infected with wild type virus carried a recurrent t(6; 9), the other showed a clonal loss of the chromosome Y. We extended our observations to cells infected with B95-8, a virus strain that hardly induces lytic replication, and found that they exhibited a pattern of CIN and aneuploidy very similar to the one induced by M81/ΔZR. We also analysed a cell line infected by B95-8 using M-FISH 60 days after infection and found that it carried a recurrent t(9; 15).

EXAMPLE 3: EBV INFECTION INDUCES CHROMOSOMAL INSTABILITY IN VIVO

We then injected resting primary B cells briefly exposed in vitro to EBV into immuno-deficient NSG mice. Although infection of resting B cells with the wild type or with replication-deficient viruses gave rise to an identical rate of cell transformation and cell growth rate in vitro, intraperitoneal injection of $4\times10^4$ B cells infected with M81 wild type gave rise to tumour development more frequently than infection with the replication-deficient mutant (FIG. 4a to c). This difference in incidence disappeared after the injection of ten times more ($4\times10^5$) EBV-infected cells. However, in that case, the tumour burden developed by the animals was higher after infection with wild type virus (FIG. 4d). Immunohistochemical analysis of the tumor samples confirmed that the tumor cells were infected by EBV, and that only cells infected with the wild type virus underwent lytic replication (FIG. 4e). The frequency of aneuploidy and centrosomal abnormalities in these tumours was 2 to 3 times higher after infection with wild type viruses relative to the M81/ΔZR mutant, and the absolute frequency of many of these abnormalities was higher than those observed in vitro (compare FIG. 2 and FIG. 5).

EXAMPLE 4: EBV INFECTION INDUCES CENTROSOME OVERDUPLICATION

Centrosome amplification can result from a centrosome overduplication during the S phase or from centrosome accumulation that takes place after mitotic slippage, when dividing cells revert to the G1 phase without partitioning their chromosomes, thereby becoming tetraploid and equipped with 2 centrosomes 19. We investigated both possibilities by staining cells with an increased number of centrosomes with an antibody against the CEP170 protein that associates with subdistal appendages of mother centrioles 20 (FIG. 6a to d). Centriole overduplication gives rise to a higher number of daughter centrioles than of mother centrioles, whilst centriole accumulation gives rise to an equal number of mother and daughter centrioles. Costaining with antibodies specific to CEP170 and to centrin revealed that more than two thirds of cells infected with wild type M81 and that displayed increased centriole numbers had undergone centriole overduplication. This proportion fell to approximately one third in cells infected with M81/ΔZR, showing that, in these cells, centrosome amplification more frequently results from centrosome accumulation. We attempted to link the observed centrosome overduplication with an alteration in the expression level of proteins involved in the control of centrosome duplication. However, cells infected by M81 or M81/ΔZR expressed the Plk4 protein, a master regulator of centrosome duplication 21, at similar levels (FIG. 6e). Similar results were obtained with immunoblots performed with antibodies specific for SAS-6 and STIL, two other proteins involved in centrosome replication.

EXAMPLE 5: SUPERINFECTION WITH EBV PARTICLES INDUCE CIN IN DIVIDING CELLS

The results gathered so far showed that EBV lytic replication increases aneuploidy and centrosome amplification. However, in most infected cell populations, an average of 5% of the cells undergo lytic replication. This subpopulation cannot account for the much higher aneuploidy and CIN rate observed in cells infected with replicating viruses. However, cells undergoing virus replication produce virions that bind to neighbour B cells in the infected B cell population. We tested whether these bound particles could generate the genetic abnormalities observed in B cells transformed with wild type EBV by treating LCLs generated with the M81/ΔZR mutant with virus-like particles (VLP) that are devoid of viral DNA and cannot establish a chronic infection. Cells were exposed for three days to purified particles to exclude contamination with soluble factors from the supernatant. We tested VLPs derived from both B95-8 or from M81. This treatment led to at least a doubling in the frequency of centrosome amplification and aneuploidy, after either type of VLP infection (FIG. 7a, b, c). Importantly, this property was not shared by VLPs that are not able to fuse with their targets because they are devoid of the gp110 protein that is required for cell entry. As we found no difference between VLPs derived from either B95-8 or M81, we concentrated on M81 VLPs that can be produced at much higher levels. We added M81 VLPs to B cells expanded by the CD40L system in the presence of IL4 and obtained very similar results in these EBV-negative cells (FIG. 7d, e, f). We also treated PWM-stimulated B cells, RPE-1 and HeLa cells with VLPs under the same conditions and also observed an increase in the percentage of cells carrying abnormal centrosome numbers (FIG. 7g to j). Similar results were obtained with RPE-1 cells stably transfected with a GFP-centrin-1 fusion protein. M81 VLP treatment of RPE-1 cells also doubled the rate of cells present in cytokinesis, suggesting that this process is delayed by the treatment. We addressed this issue by exposing HeLa cells stably transfected with mEGFP-alpha-tubulin and H2B-mCherry fusion proteins to EBV VLPs and performed life cell imaging. Although the average mitotic time was not influenced by the treatment, cytokinesis took significantly longer in cells treated with VLPs or wild type virus.

EXAMPLE 6: THE BNRF1 MAJOR TEGUMENT PROTEIN INDUCES CENTROSOME OVERDUPLICATION AND ANEUPLOIDY

We then expressed 66 EBV proteins in 293 cells to assess their contribution to CIN. We found that transfection of BNRF1, a protein that strongly potentiates the efficiency of EBV infection, doubled the frequency of centriole amplification and nearly tripled the frequency of multipolar mitoses, relative to mock-transfected cells. Staining for CEP170 revealed that transfection with BNRF1 did not increase the frequency of cells carrying more than 2 CEP170-positive centrioles, suggesting that this viral protein causes centriole overduplication. We monitored BNRF1 expression in primary B cells exposed to EBV. This protein was clearly detectable in the infected B cells during the first 5 days after infection. This observation suggests that the levels of BNRF1 protein are not reduced by cell division in the first days post infection and fits with the observation that EBV-infected B cells do not initiate cell division before 3 days after infection. They also fit with the kinetic of centrosome amplification that was visible at day 3 post-infection, at which time point BNRF1 is still available to infected cells. We then repeated the aforementioned superinfection experiments with wild type B95-8 or with a defective B95-8 mutant that lacks BNRF1. Whilst exposure of LCLs generated with the replication-deficient M81/ΔZR mutant to a recombinant B95-8 EBV devoid of the BNRF1 gene (B95-8/ΔBNRF1) did not increase centriole numbers in these cells (FIG. 8a to c), exposure to wild type viruses or to B95-8/ΔBNRF1 viruses trans-complemented with a BNRF1 expression plasmid did. We also infected primary B cells with BNRF1 knockout viruses derived from either B95-8 or M81 wild type viruses and found that the growing cells showed a striking five to tenfold reduction in the average frequency of centriole amplification and multipolar mitoses, relative to cells infected with wild type viruses (FIGS. 8d to f and h to j). Complementation of these defective BNRF1 knockout viruses with the BNRF1 protein to reconstitute a wild type virus restored the abnormalities. Similar, though less pronounced, effects were visible on the rate of aneuploidy. Primary B cells infected with either B95-8/ΔBNRF1 or M81/ΔBNRF1 virus displayed a 2.5 to 3.5-time reduction in the rate of aneuploidy relative to infection with wild type or BNRF1-complemented viruses (FIGS. 8g and k).

EXAMPLE 7: THE BNRF1 PROTEIN LOCALIZES TO THE CENTROSOMAL FRACTIONS

In an attempt to gain some insights into the mechanisms that underlie BNRF1's ability to induce centrosome amplification, we generated stable 293 cell lines that express BNRF1 under the control of a tetracyclin-responsive promoter. This allows immediate induction in more than 90% of the cells. After exclusion of the nucleus, the cellular organelles were separated on a sucrose gradient. Western blot with antibodies specific to gamma-tubulin and centrin-2 allowed identification of the gradient fractions that contained the centrosome (FIG. 9). Immunoblot with a BNRF1-specific antibody revealed that BNRF1 is exclusively located in the centrosome fractions. We also stained the sequential sucrose fractions with antibodies specific to nucleophosmine (NPM1) and to human poly (ADP-ribose) polymerase 1 (PARP1). As previously described in the literature, both proteins also sedimented in the centrosomal fractions. The expression levels of both cellular proteins was similar in the presence or absence of BNRF1, although the shorter form of PARP1 generated by caspase cleavage was overrepresented in cells expressing the viral protein.

EXAMPLE 8/FIG. 10

(a) The indicated EBV proteins were co-transfected with a CD2 expression vector into 293 cells. One day after infection, the transfected cells were stained with antibodies against the CD2 protein and against centrin. The CD2-positive cells are the cells that were successfully transfected. The dot blot shows the percentage of CD2-positive cells containing more than 4 centrioles. Cells transfected with the CD2-expression plasmid were used as a negative control. This experiment showed that cells transfected with BPLF1, BNRF1, BGLF3, BRRF2, BKRF4, or BXLF1 have an abnormally high percentage of cells that display centrosome amplification. (b) Same as in (a), except that the samples were investigated for the presence of mitoses organized around an abnormal number of centrosomes. The dot plot shows the frequency of these abnormalities after transfection of the indicated EBV proteins. (c) Same as in (a) except that the samples were investigated for the frequency of cells undergoing multipolar mitoses. The dot plot shows the frequency of these abnormalities after transfection of the indicated EBV proteins.

SEQUENCE LISTING (4 sequences)

SEQ ID NO: 1 - DNA, 171823 bp, Human herpesvirus 4
agaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagtgcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgttatgaaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgtctaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtccccctagccccgggcccagccctcctcagaaaactctgcatggagaagctggacgtgaacctcccccccagacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcactacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgatagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaacttttgttttaggatttatgcatccattatcccgcagttccacctaaacggggcttaacgttgcatcccagaagatgcacgcttaaccccgcctacaaccgtgacgtagctgtttaccagcatgtatagagttacggttcgctacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctatttttttgtggctagttttgcacccacaacatgtaagggcccgctacccctacaacacaaaacaaactatctcccctaaccatccttttgccaatcaattctgtgacagggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatggcaacattagcccaccgtgctctcagcgacctcgtgaatatgaggaccaacaaccctgtgcttggcgctcaggcgcaagtgtgtgtaatttgtcctccagatcgcagcaatcgcgcccctatcttggcccgcccacctacttatgcaggtattccccggggtgccattagtggttttgtgggcaagtggtttgaccgcagtggttagcggggttacaatcagccaagttattacacccttattttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgaccccatgtaaataaaaccgtgacagctcatggggtgggagatatcgctgttccttaggacccttttactaaccctaattcgatagcatatgcttcccgttgggtaacatatgctattgaattagggttagtctggatagtatatactactacccgggaagcatatgctacccgtttagggttaacaagggggccttataaacactattgctaatgccctcttgagggtccgcttatcggtagctacacaggcccctctgattgacgttggtgtagcctcccgtagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactacaggcccgggcccaggccttgcagggcagacggttaggctgacaaggggacaagtgtggcaggtgggcgggaaggggcacaagaatgccggcgaaactggaccacggtccaccccgccctcaagcgtccgggagccgggcggctcggctaaggagggcggccttgcgaacaattattagtagctaccaacaagggcccccagatgccccccaccagtcacccggccgtgtccactcacatattccactcttatttttaaattaatgtgtcccaattagaaacccaagcgcagaaattagttgagaggctagtgttttaaacatgcaccctaggccagccagagataatgtcacaagattatcaagttggtgtaaacacgccgtgggaaaaaatttatggttcagtgcgtcgagtgctatctttggaacagtagaaaattgaaccttgttggcgggagaaggaataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagatcagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgttcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctctcgcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttagccccagcccctcctctataagttctaggcaaacctccaatcaccagccaccttccaatgtagtctcttagagagtggctgctacgcattagagaccactttgagccacccacagtaaccacccagcgccaatctgtctacatagaagaagaagaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaaggtcagccaagggacgcgtgttatcccaggctgcccaccctgaggatttccccccaaaatcctcctaccctctctttatgccatgtgtgttgttggcttgtgttagtgctatgtaatgcgttgccgccaggtggcagcctgtttatagatgtgcagtaccccttaatgttaggtctgctttagggctgccaggtggcgcaatctaggattaattcacctgtatccctttccctccacccgcagtaacccagcactggcgtgtgacgtggtgtaaagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcagtaattccctcgaatccctaccaggaacaactgtcagacactccattaattccactaacaatctttgttggggaaaacacgggggtgcccccaccactcccaccaccccccccaccaccacccccaccacccccaccacccccaccacccccaccacccccaccacctccaccaccttcaccaccacccccgcccccaccacccccaccacctcagcgcagggatgcctggacacaagagccatcacctcttgatagggatccgctaggatatgacgtcgggcatggacctctagcatctgctatgcgaatgctttggatggctaattatattgtaagacaatcacggggtgaccggggccttattttgccacaaggcccacaaacagcccctcaggccaggttggtccagccacatgtcccccctctacgcccgacagcacccaccattttgtcacctctgtcacaaccgaggcttacccctccacaaccactcatgatgccaccaaggcctacccctcctacccctctgccacctgcaacactaacggtgccaccaaggcctacccgtcctaccactctgccacccacaccactactcacggtactacaaaggcctaccgaacttcaacccacaccatcaccaccacgcatgcatctccctgtcttgcatgtgccagaccaatcaatgcaccctcttactcatcaaagcaccccaaatgatccagatagtccagaaccacggtccccgactgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccttggagaccagagccaaacacctccagtcctagcatgcctgaactaagtccagtcctcggtcttcatcagggacaaggggctggggactcaccaactcctggcccatccaatgccgcccccgtttgtagaaattcacacacggcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctcagatgaagattatgtggagggacccagtaaaagacctcgcccctccatccagtaaaaacccttgccctctccagcaaccaatgtatcccaaataaatgttacttcttttgctcttaaccattgacacgcctgtcattctatcaattaaacaagggaaaaaggtttagctattccaccaacacgaccccaaggaaggcttgccaaaattggtgccttgctctcagcactttgccagcaacttatagcatggtaggcagctcaactcggcccgtcttactgcccagcctactctccactcccagtccatgttcgcactcctatgcatttcctgccctcccacttttaccccagtcccaacccaaaaccacacacaacacatagaattgttagtttaaacagtttattgataggtggctgcttttagcctaattgtgtattgctctcgttgccaaaacctgttgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtagccgccgggtctgctggtccggtgcacctggaaggcaggggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcttccctcagtgtttgccagcttatttccccagttttcacgtactggggcctgtggacacctgagggagcggccgttggtgggtatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggatctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaccggctgcaagcgctgccttaaaggcctggaagctgggtgggtaaatctgaccaaacagcacgctcggattcgtgatgctgtggttgatggcacacagggggtcgcagaacaggtgcttgtggaagtcttgcggggtgcacatctgcagccaggcccttagcctggggcatggcacatccagcagcgtgttttgggtcttgatgaggaacacgatcctgtctaggattttgatgttgttgccgaacgagtcaagaatcaggctcttgaagcggtcaagggtgtccttggcgtccgggtgggccccgaggctctcgcagagtgggcagatggtccgtgaggcattcttgtgccttagtccaaacatgggggccaggaggcaggggccctgcgaatggtcgccagcctccggtctggtgatggccagggccaactccgccagctcatcgccgctgtattccgcgtttaaaccgatagcatggtggcctggccccccgagcaggtccgtcccctgccacgtacctaatagtagtccacagtagtcggccttggttgtaatttcaggagagagtcctcccttttcggccctgagaaatggatgctgaactcggtttctggtaggcaggtggcagcacagggcggtgtacaggcccctgccgacgtcccctgggacatcctgggaatctttgcaggttctgggtccagggagggtaagaaaagtgggggtggttctgggccacatggacttgaagcagaagttggccggggactggccggtgaggatggatttcagaaactccaatttgtagtagccgaggttggcatttctaatcatgtcagaagaggacacagggaggaagcaccggcaaatgtaaaagtgaagctggatgtcaatggcaagaatcctggagggcatgaagagggaatccaaccccccggccatggggaagtattttatcaggatgtgtaaaaagtccatgcctgtgatgaggctagagatccaggctcgtggggcatttagacagtagtagcagagcagggcatagtcctcaaagaaggccacgggggcatctgagtgattgaccagggtgtcgagcagatcacaaactcggcaggtgctggctggagagagggactcgtaggtgtggacgagtggtgggtaggctatgccttcttccgcgttggctggaagataggagtgggccatcaaaaggccgactgcctcgaactggcttttcagattgtccacggtccagggcacaaagtcctccatctttggagttctgcccgcgatctgtgccacctctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgaccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccacgacaccgccccacgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtgtggagacaatgtgtagacgatgggcccttgttcagaagcccagggacttgaggggggctgttgtggtgctggttggggaaggagctccagggaatctttgggccatggccttggggagcttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctccccttttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggctcgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagtgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagggcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccgcgcccccagctaaggccagggctccttcggaaagaccccgcacggcctcgcagatgccccggatccacttggcggctgccagggatttccggtagggccatgagccgttcccggccgctgcccgggccagggcggcctcgaggggagcctggacaggggctttgggcggggagggaagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgctcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggccgcttcctccgctcctcgccctcctcctccttctttggcggtagccgcgggggtggcgggccaagcgtccagtctggccagagggccggtctcgatatccgtgaaccagccgggttccgcggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcctgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgatcgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcactgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctttcgtcgtccaggaccaaggggacgtccacgtgcgggcccctgtagatggaattatcctcgggttctcctcctccttcccccgcctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgcttatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagacgatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgggggatggtttttttctggttcgagtgtcgtggctgatggtgggagctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggcgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgctcgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcggggatgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccaccgctgccgtccactgccttcttccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggatgccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggagtatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactatggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttcggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggcgtgggccggagttggatcttcatcctcctcctctgaggatgaaatctctccatctgtggagtgttcttcgctgccctccatagggtccagatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaagaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggatgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccatgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgcgagtcccgccgcagtttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgtttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgctgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggctcggcacctcctcgaaggtgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtttgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagagggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggttcggaaatctgttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccccaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtagacaagttacgcctaaaggcgcagtccgccatgaccagcagcagcagaagggtcagcacagccagagaggcccactgcagtactagcatggagaggtttgagaatctgggctgggacgttggcgggactggcacggtggcttgggctgtggtaaccggtgggctcgtaaaagtccagcggggccgcagtttgctagaagtgctgggaggtagataggtggtcgcattgtatctcggtcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcattttgggggggcgtgcctttggtgacattaacctcccccggttttgtggatgtggaactgtttccagggcctgacgcttggctggtggtgcctgggcggggtgctggcgaactggtggacacatgatgtgtgctgatagaggctggtgtcacctgtgttatattttcaccacctgttgggtgagcggaggttagtaaaggcatatgtgacgttgaattgtcactggtggaggggctgagtgtctctgggtttgaactgggtctcagtgacatggaagaggttgaacttgaagttatgttatgttggcctgtggtaacagcactggttgcattttttggttggctggtaactactggggtgggacttgttcctcctaaggtgtggttggtggcatttgcctgtggacttgtttctcccacagtagggccggtggcatttggggttggggtagtcactgctgaggtggggcttgtttttcccaaggtggggctggtggcatttggggttggggtagtcactgctgaggtggggcttgtttttcccaaggtggggctggtggcatttggggttggggtagtcactgctgaggtaggacttgtttttcccaaggtggggctggtggcatttggggttggggtagtcactgctggggtggggctggtggcatttggggttggggtagtcactgctggggtggggctggtggcatttggggttggggtagtcactggtgaggtggagctggtcatgtcgggggccttactttctgtgccgttgtcccatggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgacgttggcaaacttaagggtagcgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtgcaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaatgtcctcatagagttatcagatagcagctcagaaaaggaagcagaagatgcccacctggagccggcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaagtgtgtgatgtgtgtttttacccatcacacaacaacaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcgacacttgggtgcacaggtggccgtaggtgtcacgtgaccttttccgccggcacctttaagctgccgcgatgtacccccggggatcgccagtggttgtatgttcagagctccgtgggtaacattgtacagagctgtaatccccgctacagtattttctttgactatatggctatacacaggagcctcacgaaaatctgggaggaagttttaacacctgaccagcgtgtttcatttatggaattcctaggatttttgcagagaacggatttgtcctatatcaagagctttgtcagcgatgccctgggcaccactagtatccaaacaccgtggatcgatgacaatcctagcacggagacggcacaggcttggaatgccggctttctccggggtcgtgcgtatgggatagacttgcttagaactgaaggggaacatgtcgaaggtgctaccggtgaaacgcgagaagaaagtgaggacacggagagcgatggagatgatgaagatcttccttgtatagtgtccagaggtggacctaaggtcaaacgaccccctatatttataagacgtctgcacaggttgctgctgatgagagcgggcaaacgaacagaacagggcaaggaggtactggaaaaggcccgtgggagcacttatggcacacctaggccgcctgttccgaaaccaagaccagaggtcccacaaagcgacgagacagctaccagtcacgggtcggcgcaagtcccagaacccccaaccattcacctagcagctcagggaatggcatacccattacatgaacaacacggcatggccccgtgtccggtagcacaggccccacctacgcccttgccccctgtatctccaggggatcaactcccaggtgtttttagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagattgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccccccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacctgagcagtggatgttcccaggtgccgccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgctttggggtatacactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtgggatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattgattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgcgggcaggccatgaatattgaggctcctagactgccagatgatcctataattgttgaggatgacgacgaaagtgaggaaattgaagctgaaagcgacgaggaggaagacaagagtggaatggaatctcttaaaaatataccgcaaacactgccgtacaatccaacagtatacggcaggcccgcggtgtttgaccgaaagtcagatgcaaaatcaaccaaaaaatgcagggccatagtaactgactttagtgtaatcaaggccattgaagaggaacacagaaagaagaaggcagccagaacagagcagccaagagccacgcctgaatcccaggcccccacagtggtcctccagcgaccacccacgcagcaagagcctggccccgtcggcccactgagtgtccaggctcggctggagccatggcaacctttgcctgggccccaagtgacagcagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaccacgtctcaacttagcagttcggcaccaagctgcgcacaaactccatggccggtggttcagccaagtcagactccagatgacccaacgaaacagtcccggccaccggaaacagctgccccacgccagtggccaatgcccctgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgcagacaccaccgagagcgcccactcccatgtcaccacctgaggtgccacccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcaggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacgggggggcctcgcactctcccgtcgttatcttggagaatgtcggccaggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcaggaccctgggccggggcctccatccagtggggcttctgagagattggtaccagaagagtcatactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatataccgcaaggaatatcagggatgctgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacatcttgtgcttcgtgatggcagccaggcagcgtcttcaggacattcgacgtggacccttggttgcggagggcggtgtgggttggcgacattggcttctaacatctcccagccaatcctggcccatgggatatcgtacagcaacactacgcacattaactcccgtgcctaacagggttggggctgacagcatcatgttaactgccacatttggatgccaaaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaacacgtaatccagaacgcatttcgaaaggcacaaatacagggtttatcaatgttagcaacgggaggtgaacccagaggtgatgctactagtgaaacgagcagtgatgaggacaccggtagacagggttcggacgtggagctagagtcctcggacgatgagctgccatatatcgatcccaatatggagccggttcagcagaggcccgtcatgtttgtgagccgtgtgcctgcaaagaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccacccgaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgtggggcctcctgccgcggggcctcctgccgcggggcctcctgccgcggggcctcctgccgcggggcctcctgccgcggggcctcctgccgcggggcctcgcatactggcgcctctttccgctgggcctcctgccgcggggcctcacatagtgacgcctccttccgcccggcctcgtataatggcgcctcccgtcgtacgtatgtttatgagggagcgacagctcccccagtccaccggccgtaaacctcagtgcttctgggaaatgcgggctggtcgtgaaattacacaaatgcaacaagaaccaagttcacacctgcagtccgccactcagcctacaacgcctcgcccatcatgggccccatcagtctgcgccctctcggtgatggatgctggtaaggcccagcccatagaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccgcccccccaggctccataccagggataccaggagccgccggcccacgggctccaatcatcttcatatccaggatatgcgggtccctggaccccaaggtctcaacatccatgttataggcacccctgggcaccatggtctcaagatcctgtgcatgggcacacccagggtccatgggatcccagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccccctccccctatgccgttacaagatagcatggccgtggggtgtgactcatcaggtacagcatgcccaagcatgccctttgccagtgattacagtcaaggtgcatttaccccactggacattaatgccaccacgccaaaaaggcctcgagtagaagaaagttctcacggacctgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggccgtcttgttaaagttaaccggcggtggaggatccaccggccagacctctacatttggtttgggtacccaggtgatggccgcggctgccacccgccctcctcctcttaccctgggtggcaaaaagtatgccaggagtagaacaataacaagtgcgatggcggtaaacaatggcaccctcacctgcttaaatgaaaccatggcaaccacttcaaagagagccgacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagcagccacctgcggacaaaaatcaggcgtttagatggggcatttatgtttgggacgctagccgcctgggcattcgtgttagtatatactgacctcacggtagtgctgcagcagttgcttaaacttggcccggcattttctggaagccacccgattcttgtatcgctttatttctagttcagaatcgcattcctccagctgcgagcaagggaatgcgttactacaagtggtgcctagtcagttgaaacaagccccaccatccgctgccgcccctccatgagccccaccgtccgctgccgcccctccttgagcccctccttaccgattctggctgttgtggtttccgtgtgcgtcgtgccggggcagccactggtgcaggctgtggaacaccaatgtctgctagctgttgtccttggttagccccggggcaagcaaacaccactgctgctgctgtttgaacagtagaattgtctccaggttgaggtgcttctcccccggcttggttagtctgttgattctgggttatgtcggagactgggaacagctgaggtgctgcataagcttgataagcattctcaggagcaggctgaggggcagaaaaccacgacccagtcggagcggttgaaacatgataggcagttagctggccttgtggcagaggctctggcagcaccggccacagcacacaaggcaaaggagcttgcgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctatgaggtacattagcaatgcctgtggctcatgcatagtttctaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggctcaggtccatctgtccacatatggctgcttcctccttctggggaataacagtgtcagccatctcccttagggccttcacggcctgactggtttcttcatcagggtcctccaacagatgacttgcctcgggggttactgcgggggccgggtcaagtggctggggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttccgccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttccaatttcccgaagagcttctggggcgcgttgttgttattgattcctctttgtgtgccgccagtcacgttcaggacgttatcacccatggtgttggggcgggtgttcctcgtcctcggttttcggccctgcctccggccccatcccgcgagccccagcagacatgctctcagttaacgagcagagggaatgaaagctcacggcgaaacttgggccagcccggggggacctcccctgctgttcccccagtttgccccatcgtttccctgacggcctcaggggccaagcaaaaccgcgggggcatgggatccttgcacttagccaagcctgaggaaacctcccccgccgtctccccagtatgccccatcgcttccccagcggcctccaggtccaagcagcactgcggggtcactggatcctcacaggccgcacccagcttttcttccgttgccccagtagcatctctgtctggtgaccttgaagaggaagaggaggggtcccgagaatccccatccctaccgtccagcaaaaagggggacgaggaatttgaggcctggcttgaggctcaggacgcaaatcttgaggatgttcagcgggagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggagagaagggagacacatctggaccagaaggctccggcggcagtggacctcaaagaagagggggtgataaccatggacgaggacggggaagaggacgaggacgaggaggcggaagaccaggagccccgggcggctcaggatcagggccaagacatagagatggtgtccggagaccccaaaaacgtccaagttgcattggctgcaaagggacccacggtggaacaggagcaggagcaggagcgggaggggcaggagcaggaggggcaggagcaggaggaggggcaggagcaggaggaggggcaggaggggcaggaggggcaggaggggcaggagcaggaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggggcaggaggggcaggaggggcaggagcaggaggggcaggagcaggaggaggggcaggaggggcaggaggggcaggagcaggaggggcaggagcaggaggggcaggagcaggaggggcaggagcaggaggggcaggaggggcaggagcaggaggggcaggaggggcaggagcaggaggggcaggaggggcaggagcaggaggaggggcaggaggggcaggagcaggaggaggggcaggaggggcaggagcaggaggggcaggaggggcaggagcaggaggggcaggaggggcaggagcaggaggggcaggaggggcaggagcaggaggaggggcaggagcaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggagaaaagaggcccaggagtcccagtagtcagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccatctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccgttattgcctgtgtccgacgcctgcggactcaggccaccgtctacccagaggaggacatgtgcatggcctgggcccgcttttgcgacccctctgatattaaggtggttattttgggccaggacccctatcacgggggtcaagcaaacggcctggcattcagcgtcgcatacggctttccagttccccccagcctgaggaacatctacgcggagctgcaccggagcctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagtttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgcctccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacaccgagctgtgcttgacgtaggtgacattgtaggtgaccttgacccgttcttcgtcctgctcggtgcccaccgggaccatgtcttggtcggcgaactgcgagtagttaccgaggcgtgcataattcttttggagccaggtgtgggccgtgaggcccggaagcccgaccagggtcttgtactgggccaggggatcgaggaagacctcgcactccaccgggcaggtaaacatggtcaccccgcccccatctcccccggttccccgcgcggcacgcccctgcccggcagtcttgagcgtggcatggagggtggtgaggaaggtcttgacctcggcgtgggagaggaagagccgggtccagcccacgtactgcgcggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtacgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctcggtccgactttttgagatcctgcagggaaagtacgcctacgtccagggacagaccatctacgccaacctccgcaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccatcaggagtatcgggacggaattatatgaggcaacgaaggaaataatagagtcgctcaactccacgttcatcccccagtttacggaggtgaccatcgagtaccttccgaggagcgacgagtatgtggcctactactgtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacagctgcacagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtaacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtccttgctgtcattctcttggactaacgaggagacaaagtcacagaagccagtttcaccagagaactcttgtatttgtttacagaggcaatagagatagacaaagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgtggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggccccttttgccccgtgccgcagcgtaaacgcagtgacgctcttcgcagtgggacctggggccgtagaagagggcccacatccaagggagtgggtcttcaggcaccagggaggtccaggtttgggagtgggccaatatttgcaaggcctgacctataacctcatctttgttccaggccagcgcaattcgcataaggtccccatcaaacacctcaaaacacagacccatgcccatttcaggctgagagggctccatccggctcgaccaaccttgtccaccaaactgccattcttctggtaaacgggggttgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacaggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccctgcccttcacaccccagtccaggtccagatgtgcctactaccagagctacgcgacacgttacagcgcctgctgccaccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcggattggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacacgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccacccgggggcctggagtcgatcaccttaccccaggccgaggccccttcctcatacagcgggtggctatctatccataggcaggcatccggcgtctttggtgcattggagatagtagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgataagatgcccgtcggtcagagcccttttggccccctcaaagagagacaggtaataaatctgtagctccccaaccagccctccttcatcgtaaaatcgaagggcggccacgtggaaggggttgtagagctctggaaggccctcatcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgcctcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggaggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtgaatgtcaccgtggttgtgttggtgctcagaatagcagttgtggttataggggcgctagtcgtggtcaaggtcgtagactggtttgtgctaggacccgatgccgacggtgatggtgtagtcacagccgttgtgcctgtcacgttccccgccgaggccgtcgaactgccactagatgtccaaataaggcttgtctcacagatgagtatcatggccataacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtgatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacacgcacggcacgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggttgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagagcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgaccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacagccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccataatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcatggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccacacttcccgaggatgctacccttctaatcaaatggttggacacggccctgggcagggaggccaccttttacgcgtgtcgggctatgcgtcggcttctactcggcgttatccgaatgaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataaacacgagctcaatgtttcgccttatcatccgctacttgtctcatcaccaatttgagcgctgcttcgagcagttctgccgcgtggtcccgcgtcgcttcctagggacctgtaagcgaaactctgcaaagatgctggctcatctgaatcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggatactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcccgcgagcttccagttcccctcctccccaactggctccctattgcgatgcatagttgctgcgtccctgctgccggaggtgtccgtggggcaccaggagctgtctccgctgcggtccagaagccagggagggcagacggatgtcaggtcgggcccggacccggcccggagactggtggccctcctgcgaagggaagatggggcacctaaagacccccctctgggaccgtttggacacccccgggggcccggcccggccaagagcgaagacgaggagtctgagcgtcgagacgcccctccacccccgctcgattccagcttccaagcttcccggttggtgcccgtggggcctgggtttcgcctgctcgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccgggacggtctcaacgtgtcctggtttaaggccgcaactgccaccatatctcgagtgcacgggcagacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagctggtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacattgatgagcgggataatcatcagaactttgtcgagcctgtccacgcatttgtaggcggggagatgccacgcatccctgtcttctcgctccaaagagagccgcccaagaaacccatccacagcatttgaaacggccgcctggtccagcgttgcctcctggggggccatgctcagcagcttgtctcgtgtgaggtcaaatcgtaggctgaggtagcacggtgagaagagcccgctctctgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtagtcaggtgacccagctcctccatcttgaccgtggccatcagcatggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacagcatgacccaccttaaagaaggccacagaaacctcaaacatggtagtcagcgtttccgtgtccagttccggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagaccaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtggtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgttaggtgggtcacaattggaacccgcatgctctccttcctctgagccttggcctggcgggtgtcttgggcatcatccagattcagaacattcatcacactcccacttagccgcttcagctgggcagcatgcttggataacttactaaactcgcgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgctggtggctgggctcccctgggcagggtaaaggggcacgatgtgtgccggctacccggagagtttccagtattagatgtcacggcagcctgggtccggcacggcaccctctccccagacagtccggtcggagccatcaaggggggccagtgggtgggcacctggtagaggccgtcgtcatcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtaagcgagcgcaccttcggtgttactccaagctgctctctcttaagagctgggagcaactggcctcttttttgtctctgcccccgggacccacgtttacagactttagactatttttcgaagtcaccctgggtcggagaatcgcagattgcgttgtggtagctctgcagccttatccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccacggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaactcatcgcacgggggttttgcctccttctcgtctcttgtttcgggtaggggagtaaggccgtgccaggccgccatgctcagggccacggcgtgccagaggccctcgtagtcgtgcgcatccgagaggatggcacggtccagaagcagatagccggccaggcagaggaaggccacaaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgcagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagggtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatatgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtgggggaaggagctgacacgattgagtagaaagggccaaaaatacaccagctataaggaattgctcaggccaaagttgttcctcaggtggctttaggcctaatgtaggcaattgcgtgcctagaacattgctaatgtgccctgggtttcctgccttcatgcaaatattctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctccccccgggccgatggctgaggcccggaatatgcaagtgcatctttctaaccagtaggggcctccacctaggtgctttgttaatctttagtgggaactagtgggagtgctgtgcctcgggtacccctatcctataggtcctaccggagctccttgtcttgataatccctgtaaacacacaccacctaagaacaaggcattgttaacctttggtggaacctagtgttagtgttgtgctgtaaataagtgtccagcgcaccactagtcaccaggtgtcaccggaggctacttgcctcagtgccacttttaccttctcaaatctatacggggggggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccattggggagggggggtgggtacgggagagtttgggctcgtttaaacaaagtctcatctgatgctctgtggcacctcaaggtgaatatagctgcccatcgacgtatcgctggaaaccggtgggccgctgttcacctaaagtgacgcaaggtctgtcagccgccagggtccgtttaccaggctttcaggtgtggaatttagatagagtgggtgtgtgctcttgtttaattacaccaagatcaccaccctctatccatatcccacaattgataaacctccgcatgtccaaccaccacgttgaacaggatgtggcaccctaagaggacgcaggcatacaaggttattacccagtccttgtatgcctggtgtccccttagtgggacgcaggcctaggtagcatcatttacactaaaagcagtgaccttgttggtactttaaggttggtccaatccataggctttttttgtgaaaacccggggatcggactagccttagagtaactcaaggccaagcatttcacacctgcaaatgcaccatgtaaccacagatctaaactgaaagttgcagctttagatggcaaggaaacttgggtttcaggcatagaaagcctggctcactatagcagcccatgtttgttccagggtgggggaaaggcacgtgcccttagaaaacttagctgcaaaaattctattgtgttgggagagcctctatatctaaaggcctttcctcacaatacaaatgttactaacgtctgccctctggagacctgctatgtggctagacgtatggcctacccaagacgttgggggtctcgggtaggccatgattcttccaggcataggttacaaccagtcactgctatcaagcctactcagttcccaacgcagcacataccccccgcctctcctgccatgaggacttatggcagtgtttactgttctgcttttactcttggaccaggctgtcattctatcagaataacaggggaagcaaggccccctgcttcagcgggacacgtgtttctagaatctcggagccaataactacctgcccctctaatctgtatgctgcatgaaaaaccacatacacgtgatgtaagtttagccagtttattgttacaccaatgccccgaaagtctccccctgtccctttgggtctcaggacccagccctggagctcgggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggatgggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccagctcgccttcttttatcctctttttggggtctctgtgcaataccttaaggtttgctcaggagtggggggcttctcattggttaattcaggtgtgtgattttagcccgttgggttacattaaggtgtgtaaccaggtgggtggtacctggaggtcattctattgggataacgagaggaggaggggctagaggcccgcgagatttggggtaggcggagcctcaggagggtcccctccatagggttgaaccaggagggggaggatcgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccatggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaagctggattttggccagtcttcaattttggggagtggttttgtgtgagccggaagttggcaatggggtgagggtggcgctggttaagctgacgacctcccaaggtctctcaccctgggtacacaggtggggcggcagcctctaactttggctgtggcctctatttcctccctttcctagccagggccatgtgttcctgcatgtctacttgcctcctgtggtggcagagcttggccctgggcccaacccccgccttgggagcctgtaggggccaacacccttggtttgtttgtgttcctgtttgctggcaacttactggcagccgagcagattctaatgggcgcccgccttctttctctcttgttttattaatagaatctcagccaggacctatacctgagacttcaaagtctggtcctgggttctgagacccccaagatttgtcatgcacacctgcacacctgttggtattgggtttctattcttgagtgtgaaagtttgtaaaaaaattcataaaatgtcactaattcctcttacctgtttagggtattgtgcaattcttcagcctgcctattttcaatttgcctaaggtggcaatttaagatgtggttaattaaccattttcctgtctgacaccactgcatgggcaaccgggttccatggcacatttagagataaacatagatgtcttgtcttgctcatgtgcagaggagggggtgttggtgtgcaatatagtttctggattccaaattgagttgggggtgctattttcactatggaattaaattactgacattagacagtggacaccgggctatatgtggggatgtctgtggcttgtcatttcctcttagaaggtaatcccccatcttaacttccctttaaattgtgatgcaagccctgggttatttatagaatgattatctaggtttgatagtctgaaggctgggcagagaatgtttgtaatttttattcaccttctttaccccccacgagtatccagttctagaagatctcctgatatcccgggctgccattattcccttgagtgttatagcttcctcttaacttaagcaagagctccaggatgttagcttttttggtggggctggttgtcaggaagaggttccagtgttgtcctttatttttagatgttagctttgtgttaggttagtatgggctgggtattcactagtgaaggcaactaacacagttagacgtgctagttgtgcccactggtgtttatccggtcccaaatgtcaccacagaacacagggggctggatttggcagcagcacttgtgcttttgttgatttttacccgtgtatcagagtgggggatgctagccaatttagcttcccctccccttaacagggggtctcgcggggtgccaattgtcgcctgccttcccccgcttccccttgttaacttatagcatgataggtaggtcacctaacgtggaagcctggtgggtgatccttcctcggtagggagcgcttagggctgttgagctcaacagccccacctgggtaaaatgtatgttctaaagagttacccaattataacaaaactgttgtagggtaacgaagacctgatggaagtggtattgttgccgttgaaagacgggtgtcctggctcaagttcgcacttcctatacagtgttaaagccttgtatcggaagtttgggcttcgtcccagtgtactcgataatgtcgactgctgcgaaaggtttggaccgtcttccagtaggtgttgggggtcccaaatcacgaggttaggcaggtgcacttggctctttaggagggacccttaagccagacaatgtagtgccccttttttttgcaaattggccttattattaatttcttgttaacactaattctgttctatgaccctgtgtttttcagatgccgttgaacgtgtcactgagctgaatttggacgcagctacttgacctttgcccccgtgcctccagcgctgataagtgctgcgtccactttgtgttacaggtgggccaaacctccagaatatcaattggtggggccttggtgggctgcataaggcagtaggtttgaggtgacctacttggaccatgtggatccagtgtcctgatcctggaccttgactatgaaacaattctaaaaaaatgcatcatagtccagtgtccagggacagtgcactcggaagtctcatcatctccgtttgtgtgtttagtgtggccagtacggccacccctgtgccacgccctggcatgctgctgacatctggccgccaatttcagcgggcccttttcccccttgttcaccccatagcaagaagggtaggttacatgggtattttcccatcagcacctgactggccggtgcaattagaggagagggcaacaacgcaaggctgttgttttatttgggttacaagagctgcggcggtcgatgggttcactgattacggtttcctagattgtacagatgaactagaactgtcacaatctatggggtcgtagacagtgtgcttaccagacttccatggaagatgtgaatttgctgctagctatatgggtggtgctatgggctccctagggactcatgtagtggggctttgtgatagctaatgaatgtggcagctgttgtttgtactggaccctgaattggaaacagtaacttggattctgtaacacttcatgggtcccgtagtgacaactatgctgaatatcttgaatatgggaggaggggggctttgggttccattgtgtgccctttcctggccaacgtgagggtcctagtgttatagggcgtggcagttttcttgagggctaataacccgggtgaggcggttgtcacaggtgctagaccctggagttgaaccagtaccactcggttacaaagtcatggtctagtagttgtgaccctgcaaagctacgtggggatgagcagccagggactttggttggcaagcagacaggcggcgcattggaaccccagaggagtgtcccggggccacctctttggttctgtacatattttgttattgtacataaccatggagttggctgtggtgcactccatctggtaagggggctggtgcggacgcctgtgtttagtctatgccaatgtttacctgccttgggttactattccaaacgaccacacctttgaggacacctggagccctgatcattctcggcttttactgccacctggcttctgttgggtcagacagtttggtgcgctagttgtgtgcttagcagcaacgcacaccaggctgactgccttagcagtgtggccctttattgtggcatcctaaggagggattctggagtgcctttcgcgtgaagcatgccctgagacgtactcgagttaggacttaatcgctcctgtgccgctggatgagggagcgccaatttgtacatcctagctctggccatagagttagcccacccttgtgtctccctttggcctttgcggtgccaatttccggtggtttcccttttccgcccgtttatccaatagcatgtaagagaggttgcctagatttggcaactttgagggaacgttccgtgtagctggtgacctaacacccgcccatcaccaccggacagattctgaacttgtcctgtggtgtttggtgtggttttggggtacgcaggagtacgttggaatgctttggagccgagagggatgggcccgcttgtgcgcttatgtgttacacggtgccaataaccggcccggtgcggctgccccgtgacccgtgggccttaccttcctggccatcgggggaccctggtgctagggtcccttgtgttgctttctgccataggggggaaagcatcgccttcagaattggctgctccgttggaacatttgaggcctactgtatccgtgtcctgacaacattccccgcaaacatgacatgggttaatttaaacatgttttgtttgcttgggaatgctcttagggcctggaagcttgtcattggattcatcgtttcctgaactacaggcgtagggcctattgtagcaggcatgtcttcattcctgcgtaccgaatggcatgaaggcacagcctgttaccattggcaccttttttccatgtaaacctccgtgatcctgggtcctttggagactcaagtgtgaatttgttttggtgttcggcgccagggtatctcgacgttggaatgtcaactcaacttgggcacctcgataaccggctcgtggctcgtacagacgattgtttggctctgtaacttgccagggacggctgacgatgtgtttagtctgccacttgcatccggcgctttggttactcgggagactaatggggggtgtggtatggcacaggctgggggtgagtctggggatgtccctgggcgttgctgcagcccattcgccctctggggatgagatgttcaggggtggccggtaccctacgctgccgatttacataatataaattgtaaatgctgcagtagtagggatctggacgcgcgacctgctactcttcggaaacgccaacccaggagcgtcgcctctggccccatactcccgccatgcgactgctcgccccctcccaggcctccctggtgagcccttgccgctccccgcattcctgctttcggcgcccctgcggatcccgatgacagcaggcctttccttcccccgttaatgaaaagaatgacagtgaggttgtgacagaaggacagctttattcagtttacagagtgccctcggaggctacgatattcccgttaaatgtcttgttgattctctcaaaggtggggagggaggagctctccacaacaatgttccctggcagcgtgagcgcgcagccctgccgttggatgtatcttctcatgatggtgctgatagaggggtctccggcgtagatgaaaaaggcctgggccatgctctggccggtcacgatcgttatggggttgttggaaatgttccggaccgtcagcttgagggtctggcccggcttccactcctgtgggtagacgtagaagaccgggttggaggagtgggacacgacaacggccgtaatcttggagctcaggggggcctcgtaggtgttgttgtattccagctccgtgatgaaattaggaggaataatcacaggggagccaaagtagcggatgtctgtggattccccgtcccagcgccagtggctcttagggtaggggttgtaacggaaggcaataatcacatcatccaatagggtcatgcccaccttgacgttcagcgggccctctcgtttcaggtccggcgtgtccacggagactcggacgtagcccttaccgcggcgtatggcgtttaccggacacaccttccccgggaatgtgtgaatacgggcgtatgactttagaaatgggggcgtgtgctgcgccagcaggtaaggcaggcactcgtcctggctggtgacgggagagccactgaggaagatctggggctcgctggtgtttagcttgtccccgctctgggtgcaggagcgtgtcagctgaatgtcgctctgcccgggcagaatctgcaggtagaggtaggggttcttgaccaatctgatgggcacaatgtaccaggtaaacttccctttctctatgaacaggctgcgcggattcaggacgcttagcacgatgtcctggtcagagtgcataacgaagaagggcttgaggaatacctcgttgtcttccgctccaaagaacaaaaacgcgaccgtaaagtagcggctgccgtaggtggtcgtgttgaaggagaaagaaggtaacttgaagctgagtatctggcccaccgaggggcagggaggcagctcttggcactgcgcgtccagctgcaatacctgcttgttggtgacgcggacgtatgaggggaagatctcgtacttccacacgcctctcatgaacgacgtgtctggtttttcagtgggccgcaggcggcggaggctgttcctgaacgacgagcgccgggacgctagtgctgcatgggctcctccggggtaagcttcggccatggccggagctcgtcgacgggcaaggtgagagtcggggggcgggcgacggtgcggccccaatacaactctccgctcgttagctggtagaatatccgcccggcgtctaggttgtcacttcgctcggccggccagaagagcgcaagtccaagtctggtgctggggccgatgtgcagcggtttgtgcccgcagttgtagactgtcatttttatgggcgagtgggcggtccacacgcgcgggcgcagcacccattggtcgcacgccgcctcctggaatgtaaacccccagagagagggcgtgccgccctggagatggccctgtgccatcacatgtatttcctccttgggtggaacaacggcgtcgtgctccgggtggagggggaatagcgtccaggcatctttcagggtcacgagaccggggtccatgctcagagaacagccctcccgggcggtgggcggcccgggctccagcagaacgtcgcagacccagccctcctcggccctgtccacctgtatgtccaggtgcacggacccggaggctgcgtctcgtgacatggccaggcctggtgccagccgaccacgtcccgtgtcccagccgaggccgcgccagagcagagcccgggactgactcagggccacatcccctcggcccgcggacgccgcctcgccagcccccgggccttcatgggcccgctttctacctctctccggcaccccagcctggtcagccgcagaggaagcatgaccttggggtgggacggggcaggcgtgatcctgggcgcaatctttgccgatccccacaccttcactccttgttaggttgatagaatgtcggtaccacgccacggggggcgggcccgcatagggaaaagccagggagagcgatgtgggcgaggatgggctcaggcggccccagacacgcaatttgcccccctgggcggccgcagcctgcccctcggcggcccgtgccccagctccgtcacggggggcgcataggaggggtatatctaggatagccgcacctacacaaatgagacacagacacaggtcgtgaggatttaggcaacgcaggcttgtctttatagttacaaacatgggagcgtgcacctggaagatgcagctggggtagatctttacatctttacagggcgcagcggccgccagacactgaagggcagagttcacggcgggcacctcccagagggagcccaccagcccgtacctggccacggccagggcctcgtaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcatcggcaaagcgcagggtctcgctctctgaaaacccccggcactcgataaacagcgagtccgtgtccccgtagatgactcgaagctggccctcggggttgaggggcgcccaggcgtccggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatctcgttgtcggtgcccagctgtccctcgtaggtcttggtgtcgttgataaagctgaaggacaccagggggcgcgagtagcacatggtctcggagccagggaccctcatgctcttgcgcagggtgacggtggcctggttaacgggcacgcactgggagactgagatgacatcccccaggcgcttggccgccaccgccttaccgtagatgctggacatgacggtggttggattaatcttggttagttctctcagcaccatgttctgcctcttctgctccaggcaccaggcccgcgcaaggtctcccagcatgcggttgatctggcggcgcagggagtcgtaggcaaattggatctggacggtggcgggattgttgagggtgcccagggacttcccgggggccgtggggggcaccggtgtggtggcgttccccgcatcccgcctccgacgcctcagaacggcggcgggggtgctcccgcgggccgcggatggggctgggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttctcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagcgtgtaagtgcccttgtccaggaaggctcggcgttcgccttgcgggttcgtccctcggttgtcgtagtccactatcttgtagttagttctcacgtggaaggagtctgcccgctcatggaaggtttccttatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatcttgaccgcgttgtagcactggtagatggtatccatctggtcagtttcgtagctgtcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggtgcgggctgctctggggtctgcgcaccgagacggcacgccagggcggctagcagcacgaccacgcttagcaccctacgccgagtcatctctcatttggaggtgcaggtagagaagggcatatagatccttaaatacccaccccctgcccttatacagaagaattagggggcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaatgccttctggtggggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtacagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcgtcaaacaggtgagtcagccttgcccccgccagcgcctcctcgcaggccccccgcaccagggccaggcgacgctcccgggcaaacagggcagagaggcgggaatggccgccaccctccccctgccccgttgcaccgatagcatggccgccagagttccaatagaggagctccgagagctccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagccccgcctggcggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtacggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactccgggggtccagccgggtgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcctccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccttcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatgggactggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggtgcgtagctcaccgccagctcgcatgccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttccctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattgggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatgggtacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggaagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcctggtagttgtgttgtgcagaggtctgatgtgtgtaggaggggtgggttcaacgcaggggcgttggtggcggagtctggcaacgcccgggtccttgctacctgtgtggtgtgttaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagaacccaaaagcagcgtaggaaggtgtggatcaccgccgccatggccggaatcatgactatgaccgccgcctccgtctgtcatcaaaggcgggccctggtcacctcctttgttttcaacctcttccgtcaattgtggagggcctccatcatttccagcagagtcgctagggctatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccactcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagattaaaatcgccagaaacaggaggagccaaaggagatcaaccaatagagtccaccagttttgttgtagatagagagcaataatgagcaggatgaggtctaggaagaaggctaggaagaaggccaaaagctgccagatggtggcaccaagtcgccagagcatctccaataagtagatccagatacctaagactgcgttgaaaaaagagtgttagggttggaaaagtgggggtgtggtaaataattcctagggaatgttagatcttaccaagtaagcacccgaagatgaacagcacaattccaaggaacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtatacaaagggctccaagtggacagagaaggtctcttctgaagataaagatgatcaaaattataattataagcatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtaggcccggggggatttgcggggtctgccggaggcagtacgggtacagatttcccgaaagcggcggtgtgtgtgtgcatgtaagcgtagaaaggggaagtagaaagcgtgtgtttgtgttagaaaagcgggtccccggggggcaagctgtgggaatgcggtggccaagtgcaacaggaaatggaaaggcagtgcggcaatcagaagggggagtgcgtagtgttgtgggaagcggcagtgtaatctgcacaaagaggcgcggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccgtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggggtgttggcgggggcatgggggggtcggatttcgcccttattgccctgttt

SEQ ID NO: 2 - DNA, 172764 bp, Human herpesvirus 4
agaatttgtcttgctctattcaccgttacttttcttcttgcccgttctctttcttagtatgaatccagtatgcctgcctgtaattgttgcgccctacctgttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagttcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgtgatggaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtccttatcgtcgacgctgttttgcagctgagtcccctccttggagctgtaactgtggtttccatgacgctgctgctactggctttcgtcctctggctctcttcgccagggggcctaggtactcttggtgcagcccttttaacgttggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgactaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaggataggggcagggaaacgcaaatgccggttgcccggtatgggggcccgtttattatggtaaggctcttcgggcaagatggagaggcaaacatacaggagcaaaggctatatgagctactctctgacccccgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcatcttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttagtgcaatagcatcatcgctgggctggtactaccagaccgccaccggccccggagcagatgccagggcggcggcccggcgtcaacaggcctttcagaccagggcggcggctgaatgccatgccaaaagcggggtgccggtcgtggccggcttctataggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccttacgccgaaagttcatgggcacaggcggccgtgcagacggccctcgagctgttctcggccctgtacccggccccgtgcatctcgggctacgcgcgccccccgggccccagtgctgtgatcgagcatctggggtccctagtcccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggaaaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcacgttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaagcccggcggagagaacgttaaggtttcaggtaccgtgattacattgggagaacaggggtacaaagtgtcgttggatctgagggagggaaccaggctggcaatggctgaggcgctgctgaatgcagcatttgccccaatcttggatccggaagacgtcttgctcaccctgcatctacacctggatccgcgccgggcagacaactcggtcgtgatggaggctatgacggcggcgagtgactacgcgcgtggcctgggcgtgaagctgacctttggctcggcctcctgccccgagaccggctcgtccgcctccagcttcatgactgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcgcccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcctcctttgccagcgagcagtacgagtgcctgcgaccagatcggattaaccggtccatgcacgtttccgactacggctataacgaagcactggcagtctccccgttgacaggaaagaatctcagcccacgccggctggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgttcccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggacgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtcccccgagccccgggcccagccctcctcagaaaactctgcatggagaagctggacgtgaaccttccccccccccccgacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacttaattacatggtagataaattaagagtccctcctcaccactcgaaactatggcagacattctataagataacgaggagagatgaggtgagggcagaggacattgggcaggtgtgggccacggggcagctggccatatcccccgcaccacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgagagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaactttagttttaggatttatgcatccattatcccgcagttccacctaaacggggcttaacgttgcatcccagaagatgcacacgtaaccccgcctacaaccgtgacgtggctgtttaccagcatatatagagttacggttcactacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctgtttttttgtggctagttttgcacccacaacatgtaagggcccgctacccctacaacacaaaacaaactatctccactaaccatccttttgccaatcaattctgtgacggggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtattatatgctgactgtatatgcattaggatagcatatgctacccagatatagattaggatagcatatgctacccggatatagattaggatagcatatactacccaaatagagattaggatagcatatgctacccaaatagagattaggatagcatatgctacccggatatagattaggatagcatatactacccaaatagagattaggatagcatatgctacccaaatagagattaggatagcatatgctacccggatatagattaggatagcatatgctacccaaatagagattgggatagcatatgctacccggatatagattaggatagcatatgctacccaaatagagattaggatagcatatgctacccggatatagattaggatagcatatgctacccaaatagagattgggatagcatatgctatcctaatctctatctgggtagcatatactatcctaatctctatatgggtagcatatgctatcctaatctatatctgggtagcatatactatcctaatctctatatgggtagcatatgctatcctaatctatatctgggtagcatatgctatccatcgcaacattagcccaccgtgctctcaacgacctcgtgaatatgaggaccaacaaccctgtgcttggcgctcaggcgcaagtgtgtgtaacttgtcttccagatcgcagcaatcgcgcccctatcttggcccgcccacctacttatgcaggtattccccggggtgccattagtggttttgtgggcaagtggtttgaccgcagtggttagcggggttacaatcagccaagttattacacccttagtttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggagtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgatcccatgtaaataaaaccgtgacagctcatggggtgggagatatcgctgttccttaggacccttttactaaccctaattcgatagcatatgcttcccgttgggtaacatgtgctattgaattagggttagtctggatagtatatgctactacccgggaagcatatgctacccgtttagggttaaaaagggggccttataaacactcttgctaacgccctcttgagggtccgcttatcggtagctacacaggcccctctgattgacgttggtgtagcctcccatagtcttcctgggcccctgggaggtacatgtcccccagcattggtgtaagagcttcaaccaagagttacacataaaggcaatgttgtgttgcagtccacagactgcaaagtctgcttcaggatgaaagccactcagtgttggcaaatgtgcacatccatttataaggatgtcaactacagtcagagaacccctttgtgtttggtcccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagggatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtaaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccggccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactgcaggcccgggcccaggccttgtagggcagacggttaggctgacaaggggacaagtgtggcaggtgggcgggaaggggcacaagaatgacggcgaaactggaccacggtccaccccgccctcaagcgtccgggagccaggcggttcggttaaggagggcggccttgcgaacaatcattagtagctaccaacaagggcccccagatgccccccaccagtcaccccggccgtgtccactcacatattccactcttatttttaaattaatgtgtcccaattagaaacccaagcgcagaaattagttgagaggctagtgttttaaacatgcaccctaggccagccagagataatgtcacaagactatcaagttggtgtaaacacgccgtgggaaaaaatttatggttcagtgcgtcgagtgctatctttggaacagtagaaaattgaaccttgttggcgggagaaggcataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagataagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcctggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggtttaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctccttatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggacggcctaggcccggggaagtggagggggatcgcccgggtctctgttggcagagtccgggcgatcctctgagaccctccgggcccggacggccgccctcggccccccagacagaccccagggtctccaggcagggtccggcatctccaggggcagcaggctcaccaccacaggccccccagacccgggtctcggccagccgagccgaccggccccgcgccgggcgcctcctcggagccagcccccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccagggtgtcccccagaagggaccctaggcgtcccctctcctcccctccaggcccgagcctctccctcgcggagaggggcctcttcgagccctcaagtccagtcccaccgagacccgagtggcccggatcccccaccggcccttctctttccccctactcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccaggcccagccccgtccacccctccccacgttggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccgcccaagctgctttgattcctgggatatttttgggaatggtgttaactttctccccttgtatttgctattcaatcaacctgattccccctgctcatacctccactcacaaccaagccactacggccacgtccacaacctcccgcacaggtaagtgcttttccatttttagccccagccccgcctctataagttctaggcaaacctccaatcaccagccaccttccaatgtagtctcttagagagtggctgctacgcattagcgagagatttgacccacacccagtagccacccgacgccaatctgtctacatagaagaagaagaggatgaagactaagtcacaggcttagccaggtgatttgtgaatttcagtttatttactttcttccaatcaagctttcccagcctccgcttctcaggtcccagttatgggttttccatgggggacctagtatccgttctattagattaactcgcaagatactaaaattaaccaaggtcagcccaagtgacgcgtgttatgccaggctgcccaccctgaggatttcccccaaaaatgggctgttagtagggtcctcctaccccctctttaggccaggtgtgttattttgttgtgttagtgctatgtaatgtgttgccgccaggtggcagcttgtttgtagatgtgcagcgccccttaatggtaggtctgctttagggctgccaggtggcgcaaactaggattaattcacctgtatccctttccctccacccgcagtaactcagcgctggcgtgtgacgtggtgtaaagttttgcctgaacctgtggttgggcaggtacatgccaacaaccttctaagcacccgcgcttgtgttttgctttatctgctgccatcatgcctacatactatcttgcgttacatgggggacagtcatataatctaattgttgacactgatatgtctggaaacccgtcactctccgtaattcccacgaatccttaccaggaacaactatcaaataatccattaattcaactacaaatcgttgtcggggaaaacactggggcacccgcaccgccccaaccaccccccccaccccctccacctcctccacctgagcgcagggatgcctggacacaagagcccttaccactggatatgaatcccctgggcagtgacgccagtcaaggccctctggcatcttccataagaatgctttgcatggctcaataccttcttagaaacgcacggggccaacaaggccttcttaggccactaggaccacaaacacgctctcaggtcaccttggaacgtcaacctgtccacaaccctcgccaggaggcacccatcattttgttacagagtcccgcgcccccccgattcacaccagtgcccatggtagccttaggacatactcttcaacccacaccaccaccaaggcctactcttcctcaacccagaataccactgataataccaccaaggcatactaatcaaccagccacaacaccacccacggcgccacaaaggctcacactagggcatcaactaagtctaccaccgcatcctcccccgcatcagagcaccccacattgtagttctgatagtacaggactccctccacctcccacatcttacagcattccttctatgacattatcccccgaaccattgccgccaccagcagcaccagcacacccccttccaggtgtcatttatgaccaacaagcacttcctccaactccagggccaccatggtggccacctgtccgcgaccccacgccaaccactcagactccaccaacaaatacgaaacagggcccggaccagggccagggaaggggcaggtggcggggcaggggcagaagcaagggcaggggcagaatgcacaaacttcctgaaccacggagaccagggccagacacttccagtcctagtatgcctcaattaagtccggttgtcagtcttcatcagggacaggggcctgagaactcaccaacccccggcccgtctacggccggccccgtctgtagagtgacaccttcagcaacccctgacatttcaccaatacatgaaccagagtcctctgatagtgaagaacccccctttctcttccccagtgattggtatcctccaacgttagaacctgcagaattagatgaaagttgggagggcatttttgaaacaacagaatctcatagctctgatgaagagaatgtaggggggcctagtaaaagacctcgcacctccactcagtaaaagaccttactctctccagtaatcaatgtatcccaaataaatgttaatgattttgttcttaactattgacccgcctgtcattctattaattaaacaagggaagctatgtttagctattccaccaacactgcaccaatggacagccaaaattggtgccttgctcacagctctttttgccagtggcttacagcccagtaggcagctcagaaaagtttagctattccaccaacccggccccaatgaatgcttgccaaaattggggccttgctctcagcactttgccagcgacttatagcatggtaggccgctcaactcggcctgtcttactgcccagcctactctccacttccagtccatgttcgcactcctatgcatttccttccctcccacttttatcccagtcccaacccaaaaccacacacaacacatagaattgttagtttaaacagtttattgatacatggctgcttttagcctaattgtgtattgctctcgttgccaaaacctggtgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtccaggggcagccggggttcctggcgctccggggggcagccaggcggccgccggtgggtccgctgggccgctgccccgctccgggtggggggtggccccgctgggcaccgctgcgccgccgccaggtccaggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgtgccgccgccaggtcctggggcagccggggttcctggcgctccgggggcagccgggcggccgccggtgggtccgctgggccgctgccccgctccgggtggggggtggccccgctgggcaccgctgcgccgccgccaggtccaggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtccaggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgtgccgccgccaggtcctggggcagccggggttcctggcgctccgggggcagccgggcggccgccggtgggtccgctgggccgctgccccgctccgggtggggggtggccccgctgggcaccgctgcgccgccgccaggtccaggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtcgccgccgggtctgctggtccggtgcacctgaaaggcagggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcccccctcagtgttcgccagcttatttccccagtccccacgtactggggcctgtggacacctgagggagcggccgttggtgggcatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggacctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgcctgttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaccggctgcaagcgctgccttaaaggcctggaagctgggtgggtaaatctgaccaaacagcacgctcggattcgtgatgctgtggttgatggcacacagggggtcgcagaacaggtgcttgtggaagtcttgcggggtgcacatctgcagccaggcccttagcctggggcatggcacatccagcagcgtgttttgggtcttgatgaggaacacgatcctgtctaggattttgatgttgttgccgaacgagtcaagaatcaggctcttgaagcggtcaagggtgtccttggcgtccgggtgggccccgaggctctcgcagagtgggcagatggtccgtgaggcattcttgtgccttagtccaaacatgggggccaggaggcaggggccctgcgaatggtcgccagcctccggtctggtgatggccagggccaactccgccagctcatcgccgctgtattccgcgtttaaaccgatagcatggtggcctggccccccgagcaggtccgtcccctgccacgtacctaatagtagtccacagtagtcggccttggttgtaattttaggagagagtcctcccttttcggccctgagaaatggatgctgaactcggtttctggtaggcaggtggcagcacagggcggtgtacaggcccctgccgacgtcccctgggacatcctgggaatctttgcaggttctgggtccagggagggtaagaaaagtgggggtggttctgggccacatggacttgaagcagaagttggccggggactggccggtgaggatggatttcagaaactccaatttgtagtagccgaggttggcatttctaatcatgtcagaagaggacacagggaggaagcaccggcaaatgtaaaagtgaagctggatgtcaatggcaagaatcctggagggcatgaagagggaatccaaccccccggccatggggaagtattttatcaggatgtgtaaaaagtccatgcctgtgatgaggctagagatccaggctcgtggggcatttagacagtagtagcagagcagggcatagtcctcaaagaaggccacgggggcatctgagtgattgaccagggtgtcgagcagatcacaaactcggcaggtgctggctggagagagggactcgtaggtgtggacgagtggtgggtaggctatgccttcttccgcgttggctggaagataggagtgggccatcaaaaggccgactgcctcgaactggcttttcagattgtccacggtccagggcacaaagtcctccatctttggagttctgcccgcgatctgtgccacctctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacttaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccttcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgcccagtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggatctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagctgtcgataccgggtcaggtggcgggggacaaccccaagacaccgccccgcgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagacgctgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtttggagacaatgtgtagacgatgggcccttgttcagaagcccagggacttgaggggggctgttgtggtgctggttggggaaggagctccagggaatctttgggccatggccttggggaggttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctcccctcttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggcccgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagcgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagtgcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccacacccccagctaaggccagggctccttcggaaagaccccgcactgcctcgcagatgccccggatccacttggcggctgccagggatttccggtagggccacgagccgttcccggccgctgcccgggccagggcggcctcgaggggagcctggacaggggctttgggcggggaggggagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctctgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgatcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcacgaaagagggccccggccgcttcctccgctcctcgccctcctcctccttctttggcggtagccgcgggggtggcgggccaagcgtccagtctggccagagggccggtctcgatctccgtgaaccagccgggttccacggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcccgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgaccgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcggacaatctgctgtatagtgtcacgtaggcggatgtacgtggggttctttgcggccccgactatcgaccctgcatttgcgatgtacttttctatgacggggatggtgagggccgcggtgtcggccagtggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcaccgttgggaggcttgggtcctcaaggtaggagagataatcggaggccgccgaggccaccttgtccctgatgtccgccgtacacctgcgcacgtgcagggccgcattcttggaccggacgggcacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctctcgtcgtccaggaccaaggggacatccacgtgcgggcccctgtagatggaatgatcctcgggttctcctcctccttcctccccctcctgatctccgcccgagagcaggtcggtcaggcgtctacgggccgcctccaggtcaaattttccgtcgccgctctcggccagctggggaatttcagccagcatcttagcaccggcatctacacggaccgcgtccttcgtggccagggacggcaggcaggcctccagctttgcggccaggtgctcatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagccgatcggtccctactccttattagcccctgctcgaggaccactgtcacaagaagatagtctatcatgctcaaggcatctgcctctggcacttccctgttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcaaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgagggattgtttttttctggttcgagtgtcgtggctgatggtgggagctgctgagcatgaggaggagccggggtagctgatggcaggggctgctgctgaggaggaagaggagaaggagcccgggcggctgacggcgggggctgctgctgaggaagaagtggagagggagccggggcggctgattgcgggggctgctgctgagttggaggaggagaaggagccggggcggctgattgcgggggctgctgctgagttggaggaggagaaagagtcgtggcggtgggggctgctgctgcagtcggggaaggggatggggtggtcagagggatttctgggttcgagggagctgcctgtggcagagggatgggtatttgcaaagggaggcgaggagatggagtgactgaaggagcgatagttgagactggcgcggggcggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgcccgacgcccttggtggcgtggagggagcggggaccccgggggtgtgacctaggccggggatggggatgaagaggggagggctggaggccggggccgcggaggccggggccgcggaggccggggccgcggaggccggggccgcagaggccggggccgcagaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcgggggtgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgcggacataggccggatccgcgcgcgccgtttggccggccctcagggaccggcagtatgcctcgacgtctgtccgcggggccgccgccaccgccgccgtccactgccttctcccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggagggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgccctcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagtgaggccaccacgctggaaagtgactcggggcggtgaaagagaccgccaccgccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgtggccgccagggcccgggtctctgcgatgagccgagagccgtccagcggatcgtcggtggccggagaggctgtcgtggggggcagtgaggaggccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatctcccagtccaaagatccccagctccagaggcatcagcgcgcgcaggcgggcagcggggtcgtccccagacagcagcaactgacgcgtcacgcgggcgagccccccgtccacctctgccaggggcggctgggcgtctgcccctccgctaccgccgccgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggcaactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggaggatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctacgctgtggtccagcccctacatatagaggagctgaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgttgagcatgagctcctctccaaattgattgatgagttaaaggtcaaggccaactcagaccccgaggctgatgtcctggcagggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactacggctgcaagcggccggtcagcgtggcggcctacatggagccctggcacagccagattttcaagtttttggaaacgaagctgccggagaaccacgagaggtgcccgggcatctttacggggctctttgtccccgagctcttcttcaagctttttagggacactccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgctgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctcccttagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgtcatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttgggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggtgtgggccggagttggatcttcatcctcctcctctgaggatgaaatctctccatctgtggagtgttcttcgctgccctccatagggtccatatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaggaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggacgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaagcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccacgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgtgagtcccgccgcagcttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgcttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgccgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggcccggcacctcctcgaaggcgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtctgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagggggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggtgcggaaatcagttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccctaacgccacccgacgtgcccgctcccgctcccggggacgtgaagcaaagaaagtgcaaatttctgattaataaatctttattgactttatacataggtctcggcgtcatcatatggtggggtggtgtaggtatgggatgtcgacaagttacgcctgaaggcgcagtccgccatgaccagcagcagcagaagggtcagcacagccagagaggcccactgcagtactagcatggagaggtttgagaatctgggctgggacgttggcgggacaggcacggtggcttgggctgtggtaaccggtgggctcgtaaaagtccagcggggccgcagtttgctagaagtgctgggaggtagataggtggtcgcattgtatctcgttcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcatttttggggggcgtgcctttggtgacattaacctcccccggttttgtggatgtggaactgtttccagggcctgacgcttggctggtggtgcctgggcggggcgctggcgaactggtggacacatgatgtgtgctggtagaggctggtgtcacctgtgttatattttcaccacctgttgggtgagcggaggttagtaaaggcatatgtgacgttgaattgtcactggtggaggggctgagtgtctctgagattgaactgggtctcagtgacatggaagaggttgaacttgaagttatgttatgttggcctgtggtaacagcactggttgcattttttggtgggctggtaactactggggtggaacttgttcctcctaatgtgtggttggtggtatttgcctgtggacttgtttctcccacggtagggctggtggcatttggggttggggtagtcactgctgaggtgggacttgtttttcccaaggtggggatggtggcatttggggttggggtagtcactgctggggtggggctggtggcatttggggttggggtagtcactgctgaggtgggacttgtttttcccaaggtggggctggtggcatttggggttggggtagtcactgctggggtggggctggtggcatttggggttggggtagtcactgctgaggtggggctggtcatgtcgggggccttactttctgtgccgttgtcccgtggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggagcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacagtatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgatgttggcaaacttaagggtagcgtgacatccagcccctgtgcccttactactgccgttatattggtagaattacagttatcccactttatgtatggcactgtttctggtattaggtatactgggttttgcatttctgcatggtggcaccacatggtgccaaacacatcttgaaagtagacatctacagattccaggcttacttgttgctcctctccggtggtgatgttaattggaagcttcttagaccgcatagttagagccaattctcctgcaccaaggagctccagtagaaagagattggtggcattttctgagccaccaaatgcacctcgaggttggtagacagcctttgtatggggtgtcagcaggccaaagtcaagattaagtttatgctttttgcccccgacatcgaaattgatagttgcattgacatctgccgtgcaaacattgcacgctgggtaaaatgggaattccagaatctcaacattgaaaaaaccaggatcatcacgcgtgagttggataaggctctggatggtgtactgacacacaagcaaggctgcctccattgtctcagcaccgatttctaggcagcaccctctttaataggtgcaaggggggtgcggtgttggtgagtcacactttcgttgcagacaaaatggacaaggacaggccgggtctcccggccccggatgacaacatagaagaagtaccatctacctcgggtgttcaggaacgggcgtctgagggagattgggaaaatgtcctcatagagatatcagatagcagctcagaagaggaagcagaagatgcccacctggagccatcccagaggggtaaaaagagaaaacgggtcgatgatgatgccggtggttcagctccagcacaacacgtgcccccccctcagctggatcaccctggtcgagaagccattctctacaggtttccgctagatttaagaaggtttattcaagcaattggagccgcagctacggtgagcttccctatggcccaggtgtgtgatgtgtgtttttgcccatcgcacaacaaggtaagtgatttgttgccgttggtttcagcaccccgacacgcgagccatagaccagtttttcggatcccagatttcaaataccgacctgtacgtaatgtatgccatggccattcgacaggccattagagatcgtcggaggaatccagcttctcgtagaagtcaggtcaaatggagaatgaccaccctggccgctggttggcctatgggttaccaggcatacagtagctggatgtacagctacaccgatccccaggtgactgccacgatcatacatctgcaggcgactcttgggtgcgcaagtggccgtaggtgtcatgtgaccttttctgccggcacctttaggccgccgcgatgtagtcccggggatcgccagtggttgtatgttcagagccgcgtgggtgaccttgtgcagagttctaatccatgctacagtattttctttgactacatggccatacataggagcctcacgaaaatctgggatgaagtggtaacacctgatcagcgtgttacatttatggaattcctgggctttttgcaacgcacggagttggtctacatcaagagctttgtcagctatgccttgggcaccactagtatcgaaacaccgtggatggatgagaatcctagcacagagacggcacaggcttggaatgccggcttgctccgggggcgtgcgtacgggcaagacttgcttagaactgaaggagaacatggcgaaggtgctacctgtgaaacacgggaagaaagtgaggacacagagagcgatggggatgatgaagaacttcctcgtgtagtgtccagggatggaactaagcacagacgaccccctatatttttaagacgcctgcacaggttgctgttgatgagagcgggcaaaggaaaggaacgggccagggagacactggcgaaggcccctaggcgcacttatggcacacctaggccgccagttcagaaaccaagaccagaggtcccgcaaagctatgagacagctaccagtcacgggtcggcgcaagtcccagaacccccacccacccacccattacatcagcaacacagcatggccccgtgtatggtagctcagaacccacgtgcacccttaggggaccaactcccaggtgttcctaaagatggacgaggggcgtgtgcaccggtacccgccctggccgggcctattgtccggccctgggagtcatccctgttacagtctccgggaagggcctttgcacccgttagcccacaacccatgccagtagaacccgtccctgtccctactgtggcacttgagcgaccagtttgtcccgcacctcctgagattgctatgcagggcccgggggaaccttctggcattaaacgcacacgggagcgttggaggcccgcaccgtggacgccaaacccaccccgctctcccagtcagatgtccgtgcgtgaccgtctggctcgtttgcgtgctgaggcacaggcccgtcaggctagtgttgaggtgcagcccacccagttgacccaagtatcccctcagcaaccaatggagaggccgttggaaccagagcagcagatgttccctggttccccctttagccaggtcgctgatgttgcccgggaatctggggtacctgcaatgcagcctcagtactttgacctccccttaactcaacccattagccagggggcacccgcggccccgttgagggctagtatgggcccggtacctccggtaccggcaacacagccacagtattttgacatccccttaactgaacccattaaccagggggcatccgcggcccattttctccctcagcaaccaatggaggggccgttggtacccgagcggtggatgttccaaggtgccaccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgatttggggtatccactccatgatctcaaccatcccggggttcccgtgtctcctgccgttaaccaatatcatttcagccaggctgcctttgggttacctattgatgaggatgagagtggcgagaggtccgatacctccgagccgtatgaagctcttgatttgtcaatccatggcaggccctgccctcaggcccccgaatggcctgttcaaggggagggtggccaggatgccaccgaggttcttgatttgtcaatccatggcaggccccgccctcggacccccgagtggcctgttcaaggggagagtggccagaatgtcacagaccatgaacctagaagggtggtggtgtcagctattgttcacatgtgtcaggatgacgagtttccggatctacaagatcctccagatgaggcctaagcaaaggtgtagaagtgtgtccccctccattccacccactgatatacgcccgacaataaagttgatgatattgaattccacacctactcgtgtttgtgattttatttcatattccatgagagagacctcgcatatttgcagagggtcactgaaacattttatcttaaaacagttacacctgaaaaatgaagaaagcgtggctcagcagagcacagcaagccgatgccgggggggcatctggctccgaggacccaccagattatggagatcaaggtaatgtgcaacaggtgggatctgatcctatttcacctgcgattggcccctttgaactctctgcggccagtgaggatgatcctcaatctgggccagtggaagagaatttagatgccgctgcaagagaggaagaggaacctgatgagcaggagcacaatggtggtgatgatcccttggaagtccatactcggcagcctagatttgtggatgtgaacccaacgcaggctccagtgatccaactagtccatgctgtttatgattccatgttggtaagaggcacctagaacatttccagatgtttagcttggatattttggccagtcttaatttattgtcattggtttcagcaatcggacctccggtctctaggcagtttattccttgagcaaaacctgaacatcgaagagtttatatggatgtgcatgacagtgcgtcacagatgtcaggccatcagacaaaaaccattaccgattgataagcagaggcggtggaagctcctgtcaccttacagaacctggcgtatgggttaccgtacgcaaaccctcaatgtaaacagttttgagacagggggagataaagtccacccactccttgtgactgctacgctaggatgtgaagagggcctgcggcatgcaataacttacagtgctggcattgtacagctaccacgaatgtcagaccaaaaccaaaagatagaaacagccttcttgatggcacgtcgtgctaggtcactttcggcagaaagatatactttgttctttgatttagtatcctctggaaacaccctgtatgccatatggattgggctgggcacgagaaaccgagttgcatttgtcgagtttgtaggatggctatgtaagaaggaccacactcatatacgtgaatggttccgccagtgcaccgggagaccctcaccatccaagccatggatgagagcgcatcccgtcgccgttccttatgacgatccattaacaagtgaggagactgacctggcctatgcccgtggactggccatgagtatcgaggctgctagactgccagatgatccaataattgttgaggatgacgatgaaagtgaggaaattgaagataaatgtgataaggatgaagaggaaagtggaacggaagatgttacaagcataccgcaaacactgccgcacagtccaacagtatacggcaggccctcggtgttttaccgaaagccagatactaaatcaaccaaaaaatgcagggccatagtgactgaccttagtataatcaaggtcattgaagatgaacacagaaagaagaagacagccagaacagagcaaccaagagccaagcctgattcccctgcccccacagtggtccttcggcgaccacccacgcaaaaggtgactggccctgccggttcactgagtgtccaggctcagctggagccatggcaacctttgtcctggccacatgagacaagagttatacttcacggaccacccacgcagggtgaccaagcacacggttccatgctagaccttcttgaaaaggacgaccagcacatggagcagcaggttatggcaaccctactgccaccagaaccacaccagccccggtctgggagaagagccccttgtgtctacaccgctgacctagacatagaaagtgatgagcccgccacgtcagagccggttcttgatcagctactgcccgccccaggacttggacctcttgcaattcaaccattaacgtcccccaccacgtctcaactccgcagttcagcaccgagccacgcacaaactccatggccggttacccacccaagtcagactccaggtggcccaacgacacagtccctggcaccggaaacagaagccccgcgccagtggccaatgccactgcgacctatccctctgcaccccttgcggatgcagccaatatcatttaatcctgcagtgagacccactccccatcagccacctcaggtggagcccactttctatcagtccacttgggtgaaaccccctcaacaataccagcctcagatggggcacattccatatcagccccgaccaacgggtcactctactatgctccggccccagtgggcacccaccaccatgcagccaccaccaagggcgcccactcccatgccgccacctcaggggccacccaccgctatgcagaggcctcagggggcgcccactcccatgccgccacctcaggggacacccaccgccatgcagaggcctcagggtgcgcccactcccatgccgccacctcaggggacacccaccgccatgcagaggcctcagggtgcgcccactcccatgccgccacctcaggggacacccaccgccatacagaggcctcagggtgcgcccactcccatgccgccacctcaggggacacccaccgccatgcagaggcctcagggggcgcccactcccatgccgccacctcaggggacacccaccgccatgcagaggcctcagggggcgcccactcccatgccgccacctcaggggccacccaccgccatgcagaggcctcggggggcgcccactcccatgccgccacctcaggggccacccaccgccatgcagaggcctcagggggcgcccactcccatgccgccacctcaggggccacccaccgccatgcagaggcctcggggggcgcccactcccatgccgccacctcaggggccacccaccgccatgcagaggcctcagggggcgcccactcccatgccgccacctcaggggccacccaccgccatgcagaggcctcggggggcgcccactcccatgccgccacctcaggggccacccaccgccatgcagctgtcaccaagggcacttaccggccagaaggggccagcaaagcacattctgcgccagttgttaacggggggcgtcaagagtgggagaccatcacttaagtttaaggctgcccttgagcgtcaagccgctgcgggcttgcgaccttcaccagggtctggaacgggtgccaagattgtgcaggcacctgttttctatccacccgtcctacagcccatacaagttatgtggcaagtgggttcctcaaaggccgtggccgcctcaacggtgacacaggcacccacggaatataccggggaaaggaggttaggggggcctatgtctcccactgatattccgccgtctaaacgggtgaagaaaaaggcctatccagagcgcaagacgccgcatggggggccctcacactcttccaccgttatgtgggagaatgtcagccagggacaacagcagactctggagtgcggaggaactgataaacaggaaaggaacatgttggggatgggggacattgcagtttcttccccttcctcttctgaaacatcgaatgatgagtgatttcaaccacgtaacaagaactgggatgaaccctcgggcagtatcagactgcggggaggggcagtgataagtcatgacaattttagatgaggtagacattttgcatattttcagacccaccatggaatcatttgaaggagagggggactctatacagtcacctgacaatgcgcggggagatgatgtacagaatactggtgagcatattcaggaccccgggccggggccttcaaccggcggggcttctgagggattggtgcagaacgagccggactcaagagatcaacagtcccgggggcagagaaggggtgatgaaaacagaggctggatgcagcgcatcaggcgaaggcggagaagacgggccgcattgtccggccatcttttagacatggaagacaatgtgccgccgtggtttcctccacacgatatcacaccatatgtcgcaaggaatatcagggacgctgcctgccaggctgtcaaggtgagcatgcctctaactgggttcatgggggccatctaaggcccacgtgtgacccatgtttccattaattttagcactcgcacctgcaagcgctatcaaacctgatactcgatagtggtttagacacacaacacctcttgtgcttcgtgatggcagccaggcagcgtcttcaggacattcgacgtggacccttggttgtagagggaggtgttggttggcgacattggcttctgacatctcccagccgatcctggtccatgggatatcgcacagcaacactacgcacattaactcccgtgcctaacagggttggggctgacagcatcatgttaactgccacgtttggatgccaaaatggggcactagctataaacaccttctccgccaccgtgtggataccaccccctgctggaccaagagagcaagaaagatacgctcgggaagccgaggtgcgcttccttcgtggtaaatggcagaggcggttccgaagaatctttgatttgatagaactgtgtggctctctgcaccacgtctggcaaaacatgctgcagaccgaggagaaccttttagatttcgtgcgtttcatgggtgtcatgtccagctgcaatagttcatctgtgaattactggtttcacaagacaatcggaaactttaagccatattacccgtggaatgcaccacctaatgaaaatccatatcacgcacggagaggcataaaagaacaagtaatccagaaagcatttctaaaggcacaaagacagggtttatcaatgttagcaacgggaggtggacccagaggtgatgctactagtgaaacgagcagcgatgaggataccggtagacagggttcggatgtggagctagagtcatcggacgatgagctgccatatatcgatcccaacatggagccagttcagcagaggcccgtcatgtttgtgagccgtgtgcctgtaaggaaaccgaggacactgccgtggcctacacccaagacgcacccagtgaagcgcacaattgttaagacctcctatagatctgatgaggcagaagaagcacagagcacccctgaaaggccgggcccttccaaacaaccatcagagcccgtggagcccgcccacacaaccccagcggggaggtcaacggtgattctccacgaaccacctcgagagcccgaagctgtttccttcaagcctccgccaccaccttcccggaggagaaggggagcgtgtgttgtatatgacgatgatatcatagaggtgattgatgttgaaaccaccgaagaggagacgacgtcaatgcaaagacagcctccgctcgggcaacaaccgcccccccccgtgatttctaccgggagtgccatgtcttccagtcacacggatccatcagtaacacagccaagtaagccacatcggaaacctcaagacggatttcaacgttcaggccgacgtcaaaaacgagccatgcctcccccagtgagtccttctgacgctgggcctccttccaccaggcctcgtgtcatggcgcctccttccaccgggcctcgtgtcatggcgactccttccaccgggcctcgtgacatggcgcctccttccaccgggcctcgtgacatggcgcctccttccaccgggcctcgtgacatggcgcctccttccaccgggcctcgtgacatggcgcctaccgtcgtacatatgtttacgagggagcgcctgctcacccagtccaccggccctgcacctcggagcttctgggaaatgcgggccggccgtgatgctcccaaaattcaacaagaaccaagttcacaacagcagccagccactcagtctacaccgccttgccaatcatgggtcccatctgtctatgtcctcccggcagtggatgctggtaatgcccagcccctacaaatatcacacttgagctccatgtcgcccacgcagccgatatcgcatgaagaacaaccccggtatgaggatcctgacactcctctggatttgagtttacatccagatactgcaactctgccgcccacccaggatttataccctggacgcgaggatctgcaggccacccaggctccatacccgggatacgaggagccacggcccccccaggctccttttgtaggtgactatggttttgttcaaattccctcggctcaatgggagccacacccctctcagggcacataccagggccacattgatccccagcttccggctgctctagatttagggccagagcagccccggttcccacaagatccatatgtgtattccgggggccaattgtcttcatgtccaggttatgcaggtccctggccctcgaggcctcaacatccaagatataggcacaccttggcattgtggcctcgagaacccaggcatgggcactctcagggcccatggaaaccctggtcagcacatctcccacctcagtgggatggatctgcaggacatggccaggatcaggtctcccagttcccacatctgcattcggagacaggcccaccacgtcttcaactttcatcggtgccacaggtgctgtacccgcagccactggtctcatcctctgcaccatcgtggtcatctccccagccccgagcccccatacgccccattccaacaagattcccccctccccctatgccgttacaagatagcatggccgtggggtgcgactcatcaggtacagcatgcccaagcatgccctttgccagtgattacagtcaaggtgcatttaccccactggacattaatgcccccacgccaaaaagtcctcgagtagaagaaagttctcacggacccgcccggtgttcccaagctacttctgaagcacaggagattcttagtgacaattctgagatctccgtgttcccaaaagatgcaaagcagactgactatgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcgttctttatatgaaaatgtgtattctcttgtgttgcagtatgtacagttagctttggtatagtttttgggtacctgaaacgtgtgcagggtgggtgtccaatgtggcagttttatctctttgtccccatactcctgctcggccgtcttgttaaagttaaccggcggtggaggatccaccggccagacctctacatttggtttgggtacccaggtgatggccgctgccgacacccgccctcctcctcttaccctgggtggcaaaaagtatgccaggagtagaacaataacaagtgcgatggcggtaaacaatggcaccctcacctgcttaaacgaaaccatggcaaccacttcaaagagagccaacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagaagccacctgcggacaaaaatcaggcgtttagatggggcattttatgtttgggccattagccacctgggcattcgtgttactgtatactgacctcacggtagtgctgcagcagatgcttaaacttggcccggcattttctggaagccacccgattcttgtatcgctttatatctagttcagaatcacattcctccagctgcgagcaagggaatgcgttactacaagtggtgcctagtcagttgaaacaggccccaccgtccgctgccgccctccttgagccccaccatccgctgccaccctctttgagccccaccgtccgctgccaccctctttgagccccttcttaccgattctggctgtagtggtttccttgtacgtcgtgccggggcagccgctggtgcaggctgtggagcaccaatgtctgctagctgttgtccttggttagccccgggacaagcaaacaccactgctgctgctggttgaacagtagaattgtctccaggttgaggtgcttctcccccggcttggttagtctgttgattctgggttatgtctgagactgggaatagctgaggtgctgcataagcttgataagcattctcaggagcaggctgaggggcaggaaaccacgacccagttggagcggctgaaacatgataggcagtgagctggccttgtggcagaggctctggcagcaccggccacagcacacaaggcaaaggagcttgtgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctctgaggcacattagcaatgcctgtggctcatgcatagtttccaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggttcaggtccatctgtccacatatggctgcttcctccttctggggaataacagtgtcagccatctcccttagggccttcacggcctgactggtttcctcatcagggtcctccaacagatgacttgcctcgggggttactgcgggggccgggtcaagtggccggggcactggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttcctccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaatgccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttcaaatttcccgaagagcttctggggcgcgttgttgtgattgattcctctttgtgtgccgccagtcacgttcaggacgttatcacccgtggtgttggggcgggtgttcctcgtcctcagtttttggccctgcctccggccccatcccgtaagccccagcagacatgctctcagttaacgagcagaggaaatgaaagctcacggcgaaacttgggccagcccggggggacctcccctgctgttcccccagtttgccccatcgtttccctgacggcctcaggggccaagcaaaaccgcgggggcatggggtccttgcacttagccaagcctgaggaaacctcccccgccgtctccccagtatgccccatcgcttccccagcggcctccaggtccaagcagcactgcggggtcactggatcctcacaggccgcacccagctcttcttccgttgccccagtagcatctctgtctggtgaccttgaagaggaagaggaggggtcccgagaatccccatccctaccgtccagcaaaaagggggccgatgaatttgaggcctggcttgaggctcaggatgcaaattttgaggatgttcagcgagagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcatctaataaagatgtctattgatctcttttagtgtgaatcatgtctgacgagggaccaggtacaggacctggaaatggcctaggacagaaggaagacacatctggaccagacggctccagcggcagtggacctcaaagaagagggggggataaccatggacgaggacggggaagaggacgaggacgaggaggcggaagaccaggagctccgggcggctcaggatcagggccaagacatagagatggtgtccggagaccccaaaaacgtccaagttgcattggctgcaaaggggcccacggtggaacaggagcaggaggaggggcaggagcaggaggggcaggagcaggaggggcaggagcaggaggggcaggagcaggaggggcaggagcaggaggggcaggagcaggaggggcaggagcaggaggggcaggagcaggaggggcaggagcaggaggggcaggagcaggaggaggggcaggagcaggaggggcaggagcaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggcggggcaggagcaggcggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggtgaaaagaggcccaggagtcccagtagtcagtcatcatcatccgggtctccaccgcgcaggccccctccaggtagaaggccatttttccaccctgtagcggaagccgattattttgaataccaccaagaaggtggcccagatggtgagcctgacatgcccccgggagcgatagagcagggccccgcagatgacccaggagaaggcccaagcactggaccccggggtcagggtgatggaggcaggcgcaaaaaaggagggtggtatggaaagcatcgtggtgaaggaggttccagccagaaatttgagaacattgcagaaggtttaagacttctcctggctaggtgtcacgtagaaaggactaccgaggatggaaattgggtcgccggtgtgttcgtatatggaggtagtaagacctccctttacaacctcaggcgaggaattggccttgctattccacaatgtcgtcttacaccattgagtcgtctcccctttggaatggcccctggacccggcccacaacctggcccactaagggagtccattgtctgttatttcattgtctttttacaaactcatatatttgctgagggtttgaaggatgcgattaaggaccttgttttgccaaagcccgctcctacctgcaatatcaaggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtactgttggtgtatttctggccacctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctccttctccccgacttatggctagatttcctacaactcagccccatcttccagcgcaagcttgctgccgttattgcctgtgtccgacgactgcggacacaggccaccgtctacccggaggaggacatgtgcatggcctgggcccgcttttgcgacccctctgatattaaggtggttattttgggccaggacccctatcacgggggtcaagcaaacggcctggcattcagcatcgcatacggctttccagtcccccccagcctgaggaacatctacgcggagctgcaccggagtctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagcttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttctgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcacccagctccatcccagcagtcacctccggatcccacgtacgcccgggcaggggcacagcaccaagctccgccacgtattccccgttttcacagagagaatgtcctccgtggctaaaagcgtagatgccgccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacactgagctgtgcttcacgtaggtgacattgtaggtgaccttgacccgttcttcatcctgctcggttcccaccgggaccatgtcttggtcggcgaactgcgagtagttaccgaggcgtgcataattcttttggagccaggtgtgggccgtgaggcccggaagaccgaccagggtcttgtactgggccaggggctcgaggaagacctcgcactccaccgggcaggtaaacatggtcaccccgcccccatctcccccagttccccgcgcggcgcgcccctgcccggcagtcttgagcgtggcgtggagggtggtgaggaaggtcttgacctcggcgtgggagaggaagagccgggtccagcccacgtactgcgtggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtgcgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtatagccccctgggcttggttcgcctgaactcggcggcaatgtcggagagtaccggccagtatttggccatgtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagatctccgggtcaaactcgggggagaacgtctccatatccgggagttgttggacgcggcgcttagccagggtccctatcctcctgactatacgcctcacggaggcgtctgaggtcatgttcaacatgaacgtggacgagagcgcctctggcgctctcggctcctcggccattcctgtgcaccccacgccggcctcggtccgactttttgagatcctgcagggaaagtacgcctacgtccagggacagaccatctacgccaacctccgtaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcatgagaggaccatcaggagtatcgggacggaattatatgaggcaacgagggaaataatagagtcgctcaactccacgttcatcccccagtttacggaggtgaccatcgagtaccttccggggagcgacgagtatgtggcctactactgtggccgccgcatcaggctgcatgtgctcttccccccggccatctttgccggaacggtgaccttcgacagcccggtgcagcgcctataccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacggctgcgcagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacgcggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtgacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtggttcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccgaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgactcgcttctccccggtctgggtggtcaaggcccaggacaactctattccccaggacaccttcttgtggtgggtggtcttctacctgaagcccatagttacaaacctgtacctggggtgccttgccctggagacgctggtcttctcgctcagcgtgttcctggccctgggcaacagcttttactttatggtgggggacatggtgctgggagccgtgaacctcttcctcgtcctgcccatattctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcagtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcatctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtcctggctgtcattctcttggactaacgaggagacaaagtcacagaagccagtttcaccagagaactcttgtatttgttcacagaggcaatagagatagacatagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgcggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggcccctcttgccccgtgctgcagcgtaaacacagtgacgctcttcgcagtgggacctggggccgtagaagagggcccacatccaagggagtgggtcttcaggcaccagggaggtccaggtatgggagtgggccaatatttgcaaggcctgacctataacctcatctttgttccaggccagcgcaattcgcataaggtccccatcaaacacctcaaaacacagacccatgcccatttcaggctgagagggctccatccggctcgaccacccttgtccaccaaactgccattcttctggtaaacggggattgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgccctgcagcaggatagcaccacgcaaggctgcctgggtgccgagaccccgagtattatgtacacgggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccccgcccttcacaccccagtccaggtccagatgtgcctactaccagagctacgcgacacgttacagcgcctgctgcccccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcgggttggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacgcgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggtagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggtttcccctaatctccacaggcaccgcctcacccacggcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccaccggggggcctggagtcgatcaccttaccccaggccgaggccccttcctcatacagcgggtggctatctatccataggcaggcatccggcgtctttggtgcattggagatagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccatcggcatatgctctatacccgcccctccggggggcccaggatctataggtatgggctgcatagccgcagcagactcctggaccccagaggcctctctgatcagatgcccgtcggtcagagcccttttggccccctcaaagagagacaggtaataaatctgtagctccccaaccagccctccttcatcgtaaaatcgaagggcggccacgtggaaggggttgtagagctctggaaggccctcctcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagaggcctcccaccgccacgtagacgcgggccaccgtccggggaaggtcagtggggtcccagctcagcaattgtccaaattctgtctccccaatagtgactcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagtaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtcaaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggtggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtggatgtcaccgtggttgtgttggtgctcaggatagcagttgtggttataggggcgctggtcgtggtcaaggtcgtagactggtttgtgctaggacccgatgccgacggtgatggtgtagtcacagccgttgtgcctgtcacgttccccgccgaggccgtcgaactgccactagatgtccagataaggcttgtctcacagatgagtatcatggccaggacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtaatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggcgtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacgcgcacggtgcgggtgaaagtggggcaggtcatgaatgaggcgctgaggtccctgatcatgcccacggtggggcggaggtcggagatctccagcagatccctgagcgtcccattctccaaattgtcgagtatgtcctcgtccctggtaaaatgatggctgaaggctggcccgttgtaggccagggtctgggccacgtgctgaaagtccaccccgaggccgcacatgtgggcattggtgcaggtcgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagtgcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgcccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacggccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccatgatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtaggatccgccagggtctgcaggataaacatgggaggggcgtggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacagcccctcggccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccgcacttcccgaggatgctacccttctaatcaaatggttggacacggccctgggcagggaggccaccttttacgcgtgtcgggctatgcgtcgtcttctactcggcgttatccgaataaatgactgccaggagctgccacctggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataagcacgagctcaatgtttcgccttatcatccgctacttgtctcatcaccaatttgagcgctgcttcgagcagttctgccgcgtggtcccgcgtcgcttcctagggacctgtaagcaaaactctgcaaagatgctggctcatctgaagcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggacactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcctgcgagcttccagttcccctcctccccaaccggcgccctattgcgatgcatagttgctgcggccctgctgccagaggtgtccgtggggcaccaggagctgtctccgctcatgtccagaagccatggagggcagacggatgtcaggtcgggcccggacccggcccggaggctggtggccctcctgcgaagggaagatggggcacctaaggacccccctctgggaccgtttggacacccccgggggcccggcccggccaagagcgaagacgaggagtctgagcgtcgagacgcccctccacccccgctcgatttcagcttccaagcttcccggttggtgcccgtggggcctgggtttcgcctgcttgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtagaggctatttatcccgcggccgtgtcaaactggaactcgactctagatctccatgggctggaaaatcagagcctagtcagagagaaccgaagcggggtcttttggactaccaactttccctcggtggtgtcctgccaggacggtctcaacgtgtcctggtttaaggccgcaactgccaccatatctcgagtgcacgggcggacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagcttgtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctgcccatgaccaacatgagagcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccgccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacgttgatgagcgggataatcatcagaactttgtcgagcctgtccacgcatttgtaggcggggagatgccacgcatccctgtcttctcgctccaaagagagacgcccaagaaacccatccacagcatttgaaacggccgcctggtccagcattgcctcctggggggccatgctcagcagcttgtctcgtgtgaggtcaaatcgtaggctgaggtagcacggtgagaagagcccgctctccgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtcgtcaggtgaccaagctcctccatcttgaccgtggccatcagcacggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacggcatgacccaccttaaagaaggccacagaaacctcaaacatggtagtcagcgtttccgtgtccagttctggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagatcaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgagactggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtagtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgtcaggtgggtcacaattggaacccgcgtgctctccttcctctgagccttggcctggcgggtgtcttgggcatcatccagattcagaacattcatcacactcccacttagccgcttcagctgggcagcatgcttggataacttactaaactcacgcccatgggcggccaggtgttcgaagagaccagaaggcttacccttgccaccattcttttgttttaacgcggaatgagaagagggcctgcggaaattagactcatcctcagactcacagtcagatttgtcatcaagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacgtggcttcggggtaggggcagtaggcttttggtgtgcgggtgctggtggctgggctcccctgggtagggtaaaggggcacgatgtgtgccggctacccggagagtttccagtattagatgtcacggcagcctgggtccggcacggcaccctctccccagacagtccggtcggagccatcaaggggggccagtgggtgggcacctggtagagtccgtcatcatcttcctcacctgcccctgagtcactgccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccgaggtctgtgtgccctctccacgcacgacctggcaaaatttcacagtctccccccggctagaaaggcggcaggtaagcgagcgcaccttaggtgttactccaagctgctctctcttaagagctgggagcaactagcctcttttttgtctctgcccccgggacccacgtttacggactttagactatttttcgaagtcaccctgggtcggagaatcgcagattgcgttgtggtagctctgcagccttccccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaagactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgagacctggtgtaccggatcgccaaccagatctttggggaggacgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccatggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcacgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaagtcatcgcacgggggttttgcctccttctcgtctcttgtttcgggtaggggagtaaggccgtgccaggccgccatgctcagggccacggcgtgccagaggccctcgtagtcgtgcgcatccgagaggatggcacggtccagaagcagatagccggccaggcagaggaaggccacgaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgcagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgcgccagcacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggctttgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggtcttcctgtccctgctggactcaatttaccacgattgcgatattgcacagagtcagcgcctgcccctccctcgagaacccaagttggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggccatcgatgctggatttctgagaaaccgcgtggagactctgaggcaggacaggggtgtggccaatatcccagccgagtcgtatttaaaggccagcgatgccccggacctacaaaagccggacaaggcacttcagagcccaccaccggcctccacagacccagacaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggatgccaccctctaccgcaaggacatagcgggcctctccaagagcgtgaatgagttacagcacacgctacaggccctgcgccgggagacgctgtcctacggccacaccggagtcggatactgcccccagcagggcccctgctacacccacccggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagcgtccggttggcatggtattggtcgtcttcttcccctgcagagtaattgcagtggaccccggaggccacactgcaatttctcagcgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatacgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtggggggaaggagctgacacgagtgcgtagaaagggccaaaaatacaccagctataaggaattgctcagaccaaagttgttcctcaggtggctttaggcctaatgtaggcaattgcgtgcctagaacattgctaatgtgccctgtgtttcctgccttcatgcaaatatcctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctcccccccccgggccgatggctgaggcccggaatatgcaagtgcatctttctaaccagtaggggcctccacctaggtgctttgttaatctttagtgggaactagtgggagtgctgtgcctagggtacccctatcctataggtcctaccggagctccttgccttgataatccctgtaaacacacaccacctaagaacaaggcatcgttaacctttggtggaacctagtgttagtgttgtgctgtaaataagtgtccagcgcaccactagtcaccaggtgtcaccggaggctacttgcctcagtgccacttttaccttctcaaatctatacggggggggggcctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccgttggggagggggtggtgggtacgggagagtttgggctcgtctaaacaaagcctcctctgatgctctgtggcacctcaaggtgaatatagctgcccatcgacgtatcgctggaaaccggtgggccgctgttcacctaaagtgacgcaaggtctgtcagccgccagggtccgtttaccaggctttcaggtgtggaatttagatagagtgggtgtgtgctcttgtttaattacaccaagatcaccaccctctatccatatcccacaattgataaacctccgcatgtccaaccaccacgttgaacaggatgtggcaccctaagaggacgcaggcatacaaggttattacccagtccttgtatgcctggtgtccccttagtgggacgcaggcctaggtagcatcatttacactaaaagcagtgaccttgttggtactttaaggttggtccaatccataggcttttttgtgaaaacccggggatcggactagccttagagtaactcaaggccaagcatttcacacctgcaaatgcaccatgtaaccacagatctaaactgaaagttgcagctttagatggcaaggaaacttgggtttcaggcatagaaagcctggctcactatagcagcccatgtttgttccagggtgggggaaaggcacgtgcccttagaaaacttagctgcaaaaattctattgtgttgggagagcctctatatctaaaggcctttcctcccaatacaaatgttactaacatctgccctctggagacctgctatgtggctagacttatggcctacccaagacgttgggggtctcgggtaggccgattcttccaggcataggttacaaccagtcactgctatcaagcctactcagttcccaacgcagcacataccccccgcctctcctgccatgaggactcatggcagtgtttactgttctgcttttactcttggaccaggccgtcattctatcagaataacaggggaagcaatgccccctgcgtcagcgggacacgtgtttctagaatctcggagccaataactacctgcccctctaatctgtacgctgcatgaaaaaccacatacacgtgatgtaagtttagccagtttattgttacaccaatgccccgaaagtccccccctgtccctttgggtctcaggacccagccctggagctcggggggcggccgggtggcccaccgggtccgctgggtccgctgccccgctccggtggggggtggccggctgcagccgggtccggggttccggccctggagctcggggggcggccgggtggcccaccgggtccgctgggtccgctgccccgctcccgcgggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcggggggcggccgggtggcccaccgggtccgctgggtccgctgccccgctccggcgggggggtggccggctgcagccgggtccggggttccggccctggagctcgggggggggggcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccagctcgccttcttttatcctgttttttggggtctctgtgcaataccttaaggtttgctcaggagtgggggcttcttattggttaattcaggtgtgtgattttagcccgttgggttacattaaggtgtgtaaccagctgggtggtacctggaggtcattctattgggataacgagaggaggaggggctagaggcccgcgagaattggggtaggcggagcctcaggagggtcccctccatagggttgaaccaggagggggagaatcgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaagctggattttggccagtcttaaattttggggagtggttttgtgtgagccggaagttggcaatggggtgagggtggcgctggttaagctgacgacctcccaaggtctctcaccctgggtacacaggtggggcggcagcctctaactttggctgtggcctctatttcctccctttcctagccagggccatgtgttcctgcatgtctacttgcctcctgtggtggcagagcttggccctgggcccaacccccgccttgggagcctgtaggggccaacacccttggtttgtttgtgttcctgtttgctggcaacttactggcagccgagcagattctaatgggcgcccgccttctttctctcttgttttattaatagaatctcagccaggacctatacctgagacttcaaagtctggtcctgggttctgagacccccaagatttgtcatgcacacctgcacacctgttggtattgggtttctattcttgagtgtgaaagtttgtaaaaaaattcataaaatgtcactaattcctcttacctgtttagagtattgtgcaattcttcagcctgcctattttcaatttgcctaaggtggcaatttaagatgtggttaattaaccattttcctgtctgacaccactgcatgggcaaccgggttccatggcacatttacagataaacatagatgtcttgtcttgctcatgtgcagaggagggggtgttggtgtgcaatatagtttctggattccaaaatgagttgggggtgctattttcactatggaattaaattactgacattagacagtggacaccgggctatatgtggggatgtctgtggcttgtcatttcctcttagaaggtaatcccccatcttaacttccctttaaattgtgatgcaagccctgggttatttatagaatgattatctaggtttgatagtctgaaggctgggcagagaatgtttgtaatttttattcaccttctttaccccccacgagtatccagttctagaaaatctcctgatatcccgggctgccattattcccttgagtgttatagcttcctcttaacttaagcaagagctccaggatgttagcttttttggtggggctggttgtcaggaagaggttccagtgttgtcctttatttttagatgttagctttgtgttgggttagtatgggctgggtattcactagtgaaggcaactaacacagctagacgtgctagttgtgcccactggtgtttatccggtcccaaatgtcacaacagaacacaggaggctggatttggcagcagcacgtgtgcttttgttgatttttacccttgtatcagagtgggggatgcttctggttcctggtcttctctgtgcacaaaaaggggccaatggccacggccccgcggctttttgtgccggtgcggagccaatttagcttcccctccccttagcggggggtctcgcggggtgccaattgtcgcctgccttcccctgcttccccttgttaacttatagcatgataggtaggtcacctaacgtggaagcctggtgggtgatccttcctcggtagggagcgcttagggctgttgagctcaacagccccacctgggtaaaatgtatgttctaaagagttacccaattataacaaaactgttgtagggtaacgaagacctgatggaagtggtattgttgccgttgaaagacgggtgtcctggctcaagttcgcacttcctatacagtgttaaagccttgtatcggaagtttgggcttcgtcccagtgtactcaataatgtcgactgctgcgaaggtttggaccgtcttccagtaggtgttgggggtcccaaatcacgaggttaggcaggtgcacttagctctttaggagggacccttaagccaggcaatgtagtgccccttttttttgcaaattggccttattattaaattcttgttaacactaattctgttctatgaccctgtgtttttcagatgccgttggacgtgtcactgagctgattttggacgcagctacttgacctttgcccccgtgcctccaacgccgataagtgctgcttccactttgtgttacaggtgggccaaacctccagaatatcaagtggtggggccttggtgggctgcataaggcagtaggttttaggtgacctacttggaccatgtggatccagtgtcctgatcctggaccttgactatgaaacaattcttaaaaaatgcatcatagtccagtgtccagggacagtgcactcggaagtctcatcatctccgtttgtgtgtttagtgtggccagtacggccactcctgtgccacgccctggcatgctgctgacatctgggcgccaatttcagcgggcccttttcccccttgttcaccccatagcaagaagggtaggttacatgggtattttcccatcagcacctgactggccggtgtaattagaggagagggcaacaacgcaaggctgttgttttatttgggttacaagagctgcggtggtcgatgggttcactgattacggtttcctagattgtacagatgaactagaactgtcacaatctatggggtcgtagacagtgtgcttaccagacttccatggaagatgtgaatttgctgctagctatatgggtggtgctatgggctccctagggactcatgtagtggggctttgtgatagctaatgaatgtggcagctgttgtttgtactggaccctgaattggaaacagtaacttggattctgtaacacttcatgggtcccgtagtgacaactatgctgaatatcttgaatatgggaggaggggggctttgggttccattgtgtgccctttcctggccaacgtgagggtcctagtgttatagggcgtggcagttttcttgagggctaataacccgggtgaggcggttgtcacaggtgctagaccctggagttgaaccagtaccactcggttacaaagtcatggtctagtagttgtgaccctgcaaagctacgtggggatgagcagccagggactttggttggcaagcagacaggcggcgcattggaaccccagaggagtgtcccggggccacctctttggttctgtacatattttgttattgtacataaccatggagttggctgtggtgcactccatctggtaagggggctggtgcggacgcctgtgtttagtctatgccaatgtttacctgccttgggttactattccaaacgaccacacctttgaggacacctggagccctgatcattctcggcttttactgccacctggcttctgttgggtcagacagtttggtgcgctagttgtgtgcttagcagcaacgcacaccaggctgactgccttagcagtgtggccctttattgtggcatcctaaggagggattctggagtgcctttcgcgtgaagcatgccctgagacgtactcgagttaggacttaatcgctcctgtgccgctggatgagggagcgccaatttgtacatcctagctctggccatagagttagcccacccttgtgtctccctttggcctttgcggtgccaatttccggtggtttcccttttccgcccgtttatccaatagcatgtaagagaggttgcctagatttggcaactttgagggaacgttccgtgtagctggtgacctaacacccgcccatcaccaccggacagattctgaacttgtcctgtggtgtttggtgtggttttggggtacgcaggagtacgttggaatgctttggagccgagagggatgggcccgcttgtgcgcttatgtgttacacggtgccaataaccggcccggtgcggctgccccgtgacccgtgggccttaccttcctggccatcgggggaccctggtgctagggtcccttgtgttgctttctgccataggggggaaagcatcgccttcagaattggctgctccgttggaacatttgaggcctactgtatccgtgtcctgacaacattccccgcaaacatgacatgggttaatttaaacatgttttgtttgcttgggaatgctcttagggcctggaagcttgtcattggattcatcgtttcctgaactacaggcgtagggcctattgtagcaggcatgtcttcattcctgcgtaccgaatggcatgaaggcacagcctgttaccattggcaccttttttccatgtaaacctccgtgatcctgggtcctttggagactcaagtgtgaatttgttttggtgttcggcgccagggcatctcgacgttggaatgtcaactcaacttgggcacctcgataaccggctcgtggctcgtacagacgattgtttggctctgtaacttgccagggacggctgacgatgtgtttagtctgccacttgcatccggcgctttggttacacgggagactaatggggggtgtggtatggcacaggctgggggtgagtctggggatgtccctgggcgttgctgcagcccattcgccctctggggatgagatgttcaggggtggccggtaccctacgctgccgatttacataatataaattgtaaatgctgcagtagtagggatctggacgcgcgacctgctactcttcggaaacgccaacccaggagcgtcgcctctggccccatactcccgccatgcgactgctcgccccctcccaggcctccctggtgagcccttgccgctccccgcattcctgctttcggcgcccctgcggatcccgatgacagcaggcctttccttcccccgttaatgaaaagaatgacagtgaggttgtgacagaaggacagctttattcagtttacagagtgccctcggaggctacgatattcccgttaaatgtcttgttgattctctcaaaggtggggagggaggagctctccacaacaatgttccctggcagcgtgagcgcgcagccctgccgttggatgtatcttctcatgatggtgctgatagaggggtctccggcgtagatgaaaaaggcctgggccatgctctggccggtcacgatcgttatggggttgttggaaatgttccggaccgtcagcttgagggtctggcccggcttccactcctgtgggtagacgtagaagaccgggttggaggagtgggacacgacaacggccgtaatcttggagctcaggggggcctcgtaggtgttgttgtattccagctccgtgatgaaattaggaggaataatcacaggggagccaaagtagcggatgtctgtggattccccgtcccagcgccagtggctcttagggtaggggttgtaacggaaggcaataatcacatcatccaatagggtcatgcccaccttgacgttcagcgggccctctcgtttcaggtccggcgtgtccacggagactcggacgtagcccttaccgcggcgtatggcgttgaccggacacaccttccccgggaatgtgtgaatacgggcgtatgactttagaaatgggggcgtgtgctgcgccagcaggtaaggcaggcactcgtcctggctggtgacgggagagccactgaggaagatctggggctcgctggtgtttagcttgtccccactctgggtgcaggagcgtgtcagctgaatgtcgctctgcccgggcagaatctgcaggtagaggtaggggttcttgaccaatctgatgggcacaatgtaccaggtaaacttccctttctctatgaacaggctgcgcggattcaggacgcttagcacgatgtcctggtcagagtgcataacgaagaagggcttgaggaatacctcgttgtcttccgctccaaagaacaagaacgcaaccgtaaagtagcggctgccgtaggtggtcgtgttgaaggagaaagaaggtaacttgaagctgagtatctggcccaccgaggggcagggaggcagctcttggcactgcgcgtccagctgcaatacctgcttgttggtgacgcgaacgtatgaggggaagatctcgtacttccacacgcctctcatgaacgacgtgtctggtttttcagtgggccgcaggcggcggaggctgttcctgaacgacgagcgccgggacgctagtgctgcatgggctcctccggggtaagcttcggccatggccggagctcgtcgacgggcaaggtgagagtcggggggcgggcgacggtgcggccccaatacaactctccgctcgttagctggtagaatatccgcccggcgtctaggttgtcacttcgctcggccggccagaagagcgcaagtccaagtctggtgctggggccgatgtgcagcggtttgtgcccgcagttgtagactgtcatttttatgggcgagtgggcggtccacacgcgcgggcgcagcacccattggtcgcacgccgcctcctggaatgtaaacccccagagagagggcgtgccgccctggagatggccctgtgccatcacatgtatttcctccttgggtggaacgacggcgtcgtgctccgggtggagggggaatagcgtccaggcatctttcagggtcacgagaccggggtccatgcttagaaaacagccctcccgggcggtgggcggcccgggctccagcagaacgtcgcagacccagccctcctcggccctgtccacctgtatgtccaggtgcacggacccggaggctgcgtctcgtgacatggccaggcctggtgccagccgaccacgtcccgtgtcccagccgaggccgcgccagagcagagcccgggactgactcagggccacatcccctcggcccgcggacgctgcctcgccagcccccgggccttcatgggcccgctttctacctctctccggcaccccagcctggtcagccgcagaggaagcatgaccttggggtgggacggggcaggcgtgatcctgggcgcaatctttaccgatccccacaccttcactccttgttagtttgatagaatgtcggtaccacgccacggggggcgggcccgcatagggaaaagccagggagagcgatatgggcgaggatgggctcaggcggccccagacacgcaatttgcccccctgggcggccgcagcctgcccctcggcggcccgtgccccagctccgtcacggggggcgcataggaggggtatatctaggatagccgcacctacacaaatgagacacagacacaggtcgtgaggatttaggcaacgcaggcttgtctttatagttacaaacatgggagcgtgcacctggaagatgcagctggggtagatctttacatctttacagggcgcagcggccgccagacactgaagggcagagttcacggcgggcacctcccagagggagcccaccagcccgtacctggccacggccagggcctcgtaggccgagacgggcagccggagcttgtggtactgtccctccggcaggtggagtgggacacagttagagaacattagtcccctggtccctatctccacccgccaggcatgtgtgtcagtttgcagggccatcctcgcgctcaggtggactggctaggcacccttctgaagtatctggcggtgactgtcacctggttcttgagagagtccataaaatggctgaagctccaggcgtatagtataatgagcaacagggccagacaggcggcggggcctgggtagtagcgggcaacgagagactctgtgcaatcaaaccccaggctcccggcctcacccaggaagagcagcggcagggacagcataaaccaggagaaggcgcagatgagtccggtgaaggtgacgttgcatatcaggcgcggcttccttccgaattttgtgcgcaaaagtttccagatgatgatgactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttcgcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacagtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcctcggcaaagcgcagggtctcgctctctgaaaacccccggcactcgataaacagcgagtccgtgtccccgtagatgactcgaagctggccctcggggttgaggggcgcccaggcgtctggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttcttcacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagagactgagcttgtcccggcacacggcgtacatgtctatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagagaacgcaggatatctgcaggatcaggtcagcctcgttggtggccgtggggaagccctcctcccctagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatctcgttgtcggtgcccagctgtccctcgtaggtcttggtgtcgttgataaagctgaaggacaccagggggcgcgagtagcacatggtctcggagccagggaccctcatgctcttgcgcagggtgacggtggcctggttaacgggcacgcactgggagactgagatgacatcccccaggcgcttggccgccaccgccttaccgtagatgctggacatgacggtggtgggattaatcttggttagttctctcagcaccatgttctgcctcttctgctccaggcaccaggcccgcgcgaggtctcccagcatgcggttgatctggcggcgcagggaatcgtaggcaaattggatctggacggtggcgggattgttgagggtgcccagggacttcccgggggccgcggggggcaccggtgtggtggcattccccgcatcccgcctccggcgcctcagaacggcggcggaggtgctcccgcgggccgcgggtggggcggggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttctcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagggtgtaagtgcccttgtccaggaaggctcggcgttcgccttgcgggttcgtccctcggttgtcgtagtccactatcttgtagttagttctcacgtggaaggagtctgcccgctcatggaaggtttccttatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatcttgaccgcgttgtagcactggtagatggtatccatctggtcagtttcgtagctgtcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggtgcgggctgctctggggtctgcgcaccgaggcggcacgccagggcggctagcagcacgaccacgcttagcaccctacgccgagtcatctctcatttggaggtgcaggtagagaagggcatatagatccttaaatacccaccccctgcccttatacagaagaattaggggccggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaacgccttctggtgaggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtagagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcatcaaacaggtgagtcagccttgcccccgccagcgcctcctcgcaggcccgccgcaccagggccaggcgacgctcccgggcaaacagggcagagaggcgggaatggccgccaccctccccctgccccgttgcaccgatagcatggccgccagagttccaatagaggagctccgagagttccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagcccagcctgccggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtgcggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcactaccgcagccacgtccagactccgggggtccagccgggcgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcccccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtagtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccctcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacggggggaaagcggtccctcagcctaaagaagagcgtgttcaggcacacggccggggcccggccctcgcagagcgagcacatggggctggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggcgcgtagctcaccgccagctcgcaggccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgccccaaggtaggcagagggatctagcccttcggggaagaagtcccccggctcggagctttccctcggtagggcgctgtaggcgtcgtatccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccacaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgtcttagtgtggcatggggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgcgctctcaggaacttcgcccaggtctcgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatggggacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggcagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcatctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcccggtagttgtgttgtgcagaggtctgatgtgtgtaggaggggtgggttcaacgcaggggcgttggtggcggagtctggcaacgcccgggtcctcttgctacctgtgtggtgtgtgaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagtacccaaaagcagcgtaggaaggtgtggatcaccgccgccaccgtctgtcatcgaaggcgggccccggtcacctcctttgttttcaacctcttccgtcaaatttggtgggcctccatcatttccagcagagtcgctagggttatgaggcagcgggtcatgtgggccattgtcagcagtgttgtcagggtcctgtgggccattgtcatcagtgttgtcagggtcctgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccagtcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagatcaaaatcgccagaaacaggaggagccaaaggagatcaaccaatagagtccaccagttttgttgcagatagagagcaataatgagcaggatgaggtctaggaagaaggctaggaagaaggccaaaagctgccagatggtggcaccaagtcgccagagaatctccaataagtagatccagagacctaagactgcgttgaaaaaagagtgttagggttggaaaagtgggggtgtggtaaataattcccagggaatgttagatcttaccaagtaagcacccgaagatgaacagcacaattccaaggtacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtagacaaagggctccaagtggacagagaaggtctcttctgaagataaagatgatcaaaattataattataagtatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtagggccggggggatttgcggggtctgccggaggcagtacgggtacagatttcccgaaagcggcggtgtgtgtgtgcatgtaagcgtaaaaaggggaagtagaaagcgtgtgttagtgttagaaaagcgggtccccggggggcaagctgtgggaatgcggtgggcaagtgcaacaggaaatggaaaggcagtgcggcaatcagaagggggagtgcgtagtgttgtgggaagcggcagtgtaatctgcacaaagaggcgtggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggccatgggccgcgcattcctggaaaaagtggagggggcgtggcctgccccccgcggccccctagcccccccgcacagagcggcgcaacggcgggcgggcggcggggggtcggggtccgcgggctccgggggctgcgggcggtggatggcggctggcgttcaggggaacgggggggtcggggggcgcagcggccgcgcagccatgcgtgaccgcgaggaggggacagggtcgcagggggcgtgtctggtgggggcgggagcggggggcggcgcgggagcctgcacgccgttggagggtagaatgacaggggggcggggacagagaggcggtcgcgccccccgccgcggcagccaagcccccaaggggggcggggcgcgggcagcggagcgtgacgaagggccccagggctgaccccggcaaacgtgacccggggctccggggtgacccagccaagcgtgaccaaggggccgctgggtgacacagacaaccctgacaaaggccccccaggaaagacccccggggggcatcggggggtgttggtggggccatgggggtggggccatgggccgcgcattcctggaaaaagtggagggggcgtggcctgccccccgcggccccctagcccccccgcacagagcggcgcaacggcgggcgggcggcggggggtcggggtccgcgggctccgggggctgcgggcggtggatggcggctggcgttcaggggaacgggggggtcggggggcgcagcggccgcgcagccatgcgtgaccgcgaggaggggacagggtcgcagggggcgtgtctggtgggggcgggagcggggggcggcgcgggagcctgcacgccgttggagggtagaatgacaggggggcggggacagagaggcggtcgcgccccccgccgcggcagccaagcccccaaggggggcggggcgcgggcagcggagcgtgacgaagggccccagggctgaccccggcaaacgtgacccggggctccggggtgacccagccaagcgtgaccaaggggccgctgggtgacacagacaaccctgacaaaggccccccaggaaagacccccggggggcatcggggggtgttggtggggccatgggccgcgcattcctggaaaaagtggagggggcgtggcctgccccccgcggccccctagcccccccgcacagagcggcgcaacggcgggcgggcggcggggggtcggggtccgcgggctccgggggctgcgggcggtggatggcggctggcgttcaggggaacgggggggtcggggggcgcagcggccgcgcagccatgcgtgaccgcgaggaggggacagggtcgcagggggcgtgtctggtgggggcgggagcggggggcggcgcgggagcctgcacgccgttggagggtagaatgacaggggggcggggacagagaggcggtcgcgccccccgccgcggcagccaagcccccaaggggggcggggcgcgggcagcggagcgtgacgaagggccccagggctgaccccggcaaacgtgacccggggctccggggtgacccagccaagcgtgaccaaggggccgctgggtgacacagacaaccctgacaaaggccccccaggaaagacccccggggggcatcggggggtgttggtggggccatggggggtcggatttcgcccttattgccctgttt

SEQ ID NO: 3 - DNA, 176048 bp, Human herpesvirus 4
agaattcgtcttgctctattcaccctaacttttcttcttgcccgttctctttcttagtatgaatccagtatgcctgcctgtaattgttgcgccctacctgttttggctggcggctattgccgcctcgtgtttcacggcctcagttagtaccgttgtcagcgccaccggcttggccctctcacttctactcttggcagcagtggccaactcatctgccgctgcacaaaggaaactgctgacaccggttacagttcttactgcggttgtcacttgtgagtacacacgcaccatttacaatgcataatgttcgtgagattgatctgtctctaacagttcacttcctctgcttttctcctcagtctttgcaatttgcctaacatggaggattgaagacccaccttttaattctattctgtttgcattgctggccgcagctggcggactacaaggcatttacggttagtgtgcctctgttctggaatgcaggtttgacttcatatgtatggcttggcatgacgtcaactttacttttatttcagttctggtgatgcttgtgctcctgatactagcatacagaaggagatggcgccgtttgactgtttgtggcggcatgatgtttttggcatgtctagttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaaggttcttctggcacgactgttcctatatgctctagcactcttgttgctagcctccgcgctaaccgccggtggcagtattttgcaaacaaacttcaagagtttaagtagcactgaatttatacctcgtgagtatctatttgttactcctgtttagttgaagaaaacaagctattggattgtaacacacattttacgctttgttccttagatttgttctgcatgttattactgattgtcgctggcatactctttattcttgctatcctgaccgaatggggaagtggaaatagaacatacggtcccgtttttatgtccctcggcggcctgctcaccatggtagccggcgctgtgtggctgacggtgatgactaacacgcttttgtctgcctggattcttacagcaggattcctgattttcctcattggtaagtgtgacaccaacaggtgttgccttgttatgtcactgttctgacacatgacttacatgggtttggcttttgtaggctttgccctctttggggtcattagacgctgccgttactgctgctactactgccttacactggaaagtgaggagcgcccaccgaccccatatcgcaacactgtataaaggtaagtattattaaattttagagacactatcacgtgtaacttgacgtgcaaggatggaggagaggggcagggaaacgcaaatgccggttgcccggtatgggggcccgtttattatggtaaggctcttcgggcaagatggagaggcaaacatacaggagcaaaggctatatgagctactctctgacccacgctctgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagtcccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcagagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccagcttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcgcccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctactgggaacctggtcctcctttgccagcgagcagtacgagtgcctgcgaccagatcggattaaccggtccatgcacgtgtccgactacggctataacgaagcactggcagtctccccgttgacaggaaagaatctcagcccacgccggctggtgacagagcctgacccacgatgtcaggtggccgtgctctgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgttcccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatattttgcagaatgcccaccagatcgcctgccacttccacagcaatggcacggacgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtcccccgagccccgggcccagccctcctcagaaaactctgcatggagaagctggacgtgaacctcccccccccagacctgtgtgctgtatttacaaacactacaataaaccctatgtgcaaatgtggtttgtatggctactttgtgttcctaaaaaatgcaacaatagaagtggaaaccctcagtcacgggacattaacctcaaccacaaaatggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcaccacagaagtgtaagcaaagtgaagggctcggaaggcaggcggggcctagcaatgtcacagctaaatgcccaccggggcacacactcaagcggggtctcggagctcccaggtcagaccacgaaaggtcagcctgcaaggtggatggcgtgttttctgaggttatccccgctacgtgcagtgctgggtgagagagaccctggaatgtgtcgaaatgaccaagcgtccccgcagcggggctcccaacacgggttcccagagagggtaaaagagggggccataaagcccagggtgtaaaacaccgatcgcgccaccagatggcacacgtgggggaaatgagggttagcataggcaacccccgcctacacaccaactatagcaaaccccgccccgtcacggtgacgtggtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaactttagttttaggatttatgcatccattatcccgcagttccacctaaacggggcttaacgttacatcccagaagatgcacgcttaaccccgcctacaaccgtgacgtagctgtttaccagcatgtatagagttacggttcgctacatcaaacaggacagccgttgccctagtggtttcggacacaccgccaacgcgctgtgcggtgctgccgtcccgaggtcaagtcccgggggaggagaagagcggcttcccgcctagagcatttgcaagtcaggattctctaatccctctgggagaagggtattcggcttgtccgctgtttttgtgcctagttttgcacccacaacatgtaagggcccgctacccctacaacacaaaacaatctcctctaaccaaccttttcccaatcaattctgtgacagagtttcctggacacccagtcttagttcagatagacacccagttatgcagtgccaccaattccaatcatttttaaacctcctggaattctatcatcaaacggcatgcaggaaaaggacaagcagcgaaaattcactccccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatgcaacattagcccaccgtgctctcagcgacctcgtgaatatgaggaccaacaaccctgtgcttggcgctcaggcgcaagtgtgtgtaacttgtcctccagatcgcagcaatcgcgcccctatcttggcccgcccacctacttatgcaggtattccccggggtgccattagtggttttgtgggcaagtggtttgaccgcagtggttagcgaggttacaatcagccaagttattacacccttagtttacagtccaaaaccgcagggcggcgtgtgggggctgacgcgtgcccccactccacaatttcaaaaaaaagagtggccacttgtctttgtttatgggccccattggcggggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccttagcaataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgttcaaattttattctgggggcgtcacctgaaaccttgttttcgagcacctcacatacaccttactgttcacaactcagcagttattctattagctaaacgaaggagaatgaagaagcaggcgaagattcatgagagttcactgcccgctccttgatcttcagccactgcccttgtgactaaaatggttcactaccctcgtggaatcctgaccccatgtaaataaaaccgtgacagctcatggggtgggagatatcgctgttccttaggaccattttactaaccctaattcgatagcatatgcttcccgttgggtaacatgtgctattgaattagggttagtctggatagtatatgctactacccgggaagcatatgctacccgtttagggttaaaaagggggccttataaacactcttgctaacgccctcttgagggtccgcttatcggtagctacacaggcccctctgattgacgttggtgtagcctcccatagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtcccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcactcccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtaaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcttcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaaaatgcgaaactacaggcccgggcccaggccttgcagggcagacggttaggctgacaagtggacaagtgtggcaggtgggcgggaaggggcacaagaatgccggcgaaactggaccacggtccaccccgccctcaagcgtccgggagccgggcggctcggccaaggagggcggccttgcgaacaatcattagtagctaccaacaagggcccccagatgcccccaccagtcaccccgtccgtgtccactcacatattccactcttatttttaaattcatgtgtcccaattagaaacccaagcgcagaaattagttgagaggctagtgttttaaacatgcactctaggccagccagagataatttcacaagactatcaagttggtgtaaacacgccgtgggaaaaaatttatggttcagtgcgtcgagtgctatctttggaacagtagaaaattgaaccttgttggcgggagaaggcataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttcttctgcaaattttagatcagatggcatagagacaaggacaccgaagacccccagagccctcatcgcagggttcttaccatgtggccatgtaggcccacttaacactacaagacctacgcctccccattcatcatgtaacccgcaaatcatctaaaccgtaagtctaagggcctcctgaggttttctcaggaggccctaatgtataattaatcatgcatttgatttaaaaaaagtaggttatactcattttaggccagtctttatttgcagattaataatttatgtgattctccttccctctaggactgaagaaacagcctcctgcacgtgagcatgtatctgaaataattattatgtcataagtgtaatgatgagaaagtcataaacccacttccctttacatgaatctgggcactgaattttggggtacctctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatataattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccagcggcccttctctctgtccccctgctcctctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacgttggacaggccctctgtccacccgggccatccccgcccccctgtgtccaccccagtcccgtccaggggggactttatgtgaccattgggcctggctccccatagactcccatgtaagcctgcctcgagtaggtgcctccagagccccttttgcccccctggcggcccagcccgacccccgggcgcccccaaacgttgtccagatgtccaggggtccccgagggcgaggcccagccccctccctcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttatccccagcccctcctctataagttctaggcaaacctccaatcaccagccaccttccaatgtagtctcttagagagtggctgctacgcatgagagccagctttgagccacccacagtaaccacccagcgccaatctgtctacatagaagaagaggaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaagggcagccaagggacacgtgttatcccaggctgcccaccctgaggatttccccccaaaatcctcctaccctctctttatgccatgtgtgttgttggcgtgtgttagtgctatgtaatgcggtgccgccaggtggcagcctgtttatagatgtgcagtaccccttaatgttaggtctgctttagggctgccaggtggcgcaatctaggattaatccacctgtatccctttccctccacccgcagtaacccagcactggcgtgtgacgtggtgtaaagttttgcctgaacctgtggttgggcaggtacatgccaccaaccttctaagcacccgcgcttgtgttttgctttatctgccgccatcatgcctacattctatcttgcgttacatgggggacaaacatatcatctaattgttgacacggatagtcgtggaaacccgtcactctcagtaattccctcgaatccctaccaggaacaactgtcagacactccattaattccactaacaatctttgttggggaaaacacgggggtgcccccaccacccccaccacccccaccacccccaccacccccaccacctccaccaccttcaccaccttcaccaccttcaccacctccaccacctccaccacctccaccacctccaccacctccaccacctcagcgcagggatgcctggacacaagagccatcacctcttgatagggatccgctaggatatgatgtcgggcatggacctctagcatctgctatgcgaatgctttggatggctaattatattgtaagacaatcacggggtgaccggggccttatgttgccacaaggcccacaaacagccccccaggccgtgttggtacagccacatgtcccccctctacgcccgacagcacccaccattttgtcacctctgtcacgaccgaggcttacccctccacaaccactcacgatgccaccaaggcctactcctcctacccctctgccacctgcaacactacttacggtgccaccaaggcctacccgtcctaccactctgccacccacaccactactcacggtactacaaaggcctaccgaacttcaacccacaccatcaccacaaagcatgcatctccctgtcttgcatgtgccagaccaatcaatgcaccctcttactcatcaaagcaccccaaatgatccagatagtccagaaccacggtccccaaatgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccatggagaccagagccaaacacctccagtcctagcatgcctgaactaagtccagtcctcggtcttcatcagggacaaggggctggggactcaccaactcctggcccatccaatgccgcccccgtttgtagaaattcacacacagcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctctgatgaagattatgtggggggacccagtaaaagacctcgcccctccacccagtaaaaaaccttgccctctccagcaaccaatgtatcccaaataaatgttacttcttttgctcttgaccattgacacgcctgtcattctatcaattaaacaagggaaaaaggtttagctattccaccaacacgaccccaaggaaggcttgccaaaattggggccttgctctcagcactttgccagcaacttatagcatggtaggcagctcaactcggcccgtcttactgcccagcctactctccactcccagtccatgttcgcactcctatgcatttccttccctcccacttttaccccagtcccaacccaaaaccacacacaacacatagaattgttagtttaaacagtttattgatacatggctgcttttagcctaattgtgtattgctctcgttgccaaaacctggtgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtccaggggcagccggggttcctggcgctccgggggcagccgggcggtcgccggtgggtccactgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgcgggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgccgatccctcccccccagggcgtacccggcttgcctggttctggggctcctctgggggtcgctgcatccgccggtagggttagaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtcgccgccgggtccgctggtccggtgcacctggaaggcagggggggggggggcgtaagggaggggcgtggtcctgggaccccgcgccgactggcagggggtccccgtggcacagggctaggggtccggggggcagccgcggcccagcgcaccccgttcacgggggaggaccgcggccgagccaccatgggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggtcattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccatgatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggccccccgcgtgccttcctgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccgggggcggaaggggacgttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcccccctcagtgttcgccagcttatttccccagtccccacgtactggggcctgtggacacctgagggagcggccgttggtgggcatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcaccagaggacactgtagttctgcgttatcatgtgttgcttgaggagataattgaacgaaattcagagacatttacagaaacttggaacagatttataacacacaccgaacatttggacctggattttaactcagtatttttagagatatttcaccgtggagacccaagccttgggcgcgcgttggcctggatggcctggtgcatgcatgcctgtaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcagggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggttatacgcctgtggtgttctaacgggaagtgtgtaagcacacacataatttgcaagcggtgcttcacgctcttcgttaaaataacacaaggacaagatactaaagaaataactgaggtgagtgtgggaagatgggactacgatgtgttatgttaacgggtgagagcctatactgcagcccagactcggggggaggaggaaatggtaagagttatactctacttatcttttttgacactacagttaactgttatgtaacaatgtttgcttattttcatgttcaataaacgctatgttaatgatgaagaacctgtgttgttctttggaagtgggcccgatggggtagtaggttttgggagggtgccgtgctagatatttcaactgccacagaccccattttgtcccacctgttaccacattctaggtcctgcatccagtgggccaggtgtctccccatggctctttctaggtggatcccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagtttcaagagttaaaagcaactactgtttattttccaaaatgagctgggtatagttgatgatctgtaggcgcagctcatccccacattccaggtccttgatggcctcgtagatggcatcttcgtcgacattgacagtcttctcatataccgtgtctctggggctgacctttatgcagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgagcgggccacactgccaaccctttccattcttcccagctctgagcgagattttccacacctggacaccgacttcacgctatgtgccgaggcttttgaggccgtatagtttctgtggtgcggatgcattaggcggcgcaatgtgggatctgccggccgctgtcggcgtgcatccacggcctctggggtgaccggggccatcggttttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaccggctgcaagcgctgccttaaaggcctggaagctgggtgggtaaatctgaccaaacagcacgctcggattcgtgatgctgtggttgaaggcacacagggggtcgcagaacaggtgcttgtggaagtcttgcggggtgcacatctgcagccaggcccttagcctggggcatggcacatccagcagcgtgttttgggtcttgatgaggaacacgatcctgtctaggattttgatgttgttgccgaatgagtccagaattaggctcttgaagcggtcaagggtgtccttggcgtccgggtgggccccgaggctctcgcagagtgggcagatggtccgtgaggcattcttgtgccttagtccaaacatgggggccaggaggcaagggccctgcgaatggtcgccagcctccggtctggtgatggccagggccaactccgccagctcatcgccgctgtattccgcgtttaaaccgatagcatggtggcctggccccccgagcaggtccgtcccctgccacgtacctaatagtagtccacagtagtcggccttggttgtaatttcaggagagagtcctcccttttcggccctgagaaatggatgctgaactcggtttctggtaggcaggtggcagcacagggcggtgtactggcccctgccgacgtcccctgggacatcctgggaatctttgcaggttctgggtccagggagggtaagaaaagtgggggtggttctgggccacatggacttgaagcagaagttggccggggactggccagtgaggatggatttcagaaactccaatttgtagtagccgaggttggcatttctaatcatgtcagaagaggacacggggaggaagcaccggcaaatgtaaaagtgaagctggatgtcaatggccagaatcctggagggcatgaagagggaatccaaccccccggccatggggaagtattttatcaggatgtgtaaaaagtccatgcccgtgatgaggctagagatccaggctcgtggggcatttagacagtagtagcagagcagggcatagtcctcaaagaaggccacgggggcatctgagtgattgaccagggtgtcgagcagatcacaaactcggcaggtgctggctggagagagggactcgtaggtgtggacgagtggtgggtaggctatgccttcttccgcgttggctggaagataggagtgggccatcaaaaggccgactgcctcgaactggcttttcagattgtccacggtccagggcacaaactcctccatctttggagttctgcccgcggtctgtgccacctctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaaggtgggctagcaagttctcgagtctatgaagactccgggggcagttttttgagtttctcgcctatgatccaccccaatctcgcccccataattgcgccatctgcctacgcgaggctgaacctcctgaatcactgcatctttctcgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcctgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctagcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccctgagacccgggagacggtggtggggggagcatggcgttattcttggcgcgccacaccttatctggcacgggtgctggcggtcacggccgtggccctgctcctgatgtttctgaggtggacctgacgttgccggcccttgaggagcgggagttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagcgttcaccggtggtgggtgtggagccgtggccttttgcaacgccttttttcctagcttattttttggttgtgcggtctgttttccccgcgttttccgatagaatagctgcctggatctgcgcccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagcgcccactgtcttttgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccctgggcctacaagtgtttcagatccctcgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcagccccgaatccgggcggtgctgccgcacaacgcggcctatgagctcgaccgtggctcccgcctcttggatgccatcatcccctgcttgggacccgaccgcacatgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaaggagttacctggtatttctgacgtcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccaagacaccgccccgcgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacaggactcggctagcctgactaagggtgaggctataacgcaggtcctgttccggagcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttcaaaaggcgcgggatagcgtgcgctaccggatggcgggtaatacatgctatccttacattttggcattttgggcagctgggaggcggcggatgggggtgcttctttttgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcccccaccgctttaattgtgggggtgggcagggcagctgcatcttggggcctctgtgcttgcgttttttgggggcttggtgccaatgcaccaactggggtgtgcgcgggggcggccaagccggaccccagggcgggtgcctgggggatgggaaggccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtgaataactgggcttctgtgaaggcaccaaccctggaatctggatggtatgtttcttctgtgaccccgaggcagtcgatggtgtagagtgtggagacaatgtgtaaacgatgggctttgaggggggctgttgtggtgctggttggggaaggagctccagggaatctttgggccatggccttggggaccttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgcctggggccaccttctctaagagagggctctgtgggctgggagggccagaggcctcagattcagccgtagtgctccccttttccccctggtctgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtttggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctccggctcgaaagactcggagtagccgtccaggtcctgcagaaaattcagcgagatggtctccaccagggaccggaagggctcggagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctgggaagctcttctccgcgtgtataggcctgcttcacaaagtcacgcaggtagtcctgaaacgcgaccgggccctccagcgggcgcaatgagtgccagagctgctgaagggcctcgggggcgaagcaccggcgtgcgaggagcagcatgcaggctcgggcgcgggccgtgctttggttgtggaccaggcccaagaactcggggtgcggccagagggcggcccgggtatccatctcctcccaggcgtcctggaagaagatgaagccggtgggtggaccggcgatgcggtggcgggtgaggcggcgcgcgtcttccccgtcgtcgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccattatctcccgttgttccaatagaataacttcccggtctgtggccggggctggataagggggtgattcctagaggcgatgagactggcgtgcgctaaaagcgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagtgcatactgggagccagccgaggccccaagcgccaggcccctggcagcctccaccacgatcttgagctggcgcgggtcggtgtggcccctggcctgggtgaccaggtcctgcagcgttccctgcagctgggactcttcctgggcctcctggatgatggcctccagtcgggagaggcgccttttccagtctgcgaaggtctccttgccccccgcgacccgcttggggtccaacgtggccagagccaacctcagctcctccatgccatccatggaattctgggccatgccctcgacttccaggagccgtgttagctcatgaatttcaccgtcagccgcagcggctaggttcagccaggcacccacacccccagctaaggccagggctccttcggaaagaccccgcacggcctcgcagatgccccggatccacttggcggctgccagggatttccggtagggccacgagccgttcccggccgctgcccgggccagggcggcctcgaggggagcctggacaggggctttgggcggggaggggagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggtttcttaggccagagtgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgatcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggctgcttcctccgctcctcgccctcctcctccttctttggcggtagccgcgggggtggcgggccaagcgtccagtctggccagagggccggtctcgatctccgtgaaccagccgggttccgcagcctccattctctccgccgcaccaccatcgtccacgagcagggattgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcccgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgaccgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtacttcttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctgggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcaccgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctctcgtcgtccaggaccaaggggacgtccacgtgcgggcccctgtagatggaattatcctcgggttctcctcctccttctcccccctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgctcatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagcagatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggttcctctaggtcagacaggtagcggacgaggccagcacccccagatgcatcttccccaaaggagggctgctgcccgaagggaggtgatggggatatctccgttccagccctgtcagcggccgggggatggtttttttctggttcgagtgtcgtggctgatggtgggatctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggtgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgcccgacgcccttggtggcgtggagggagcggggaccccgggggtgtgacctaggccggggagtggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagcttttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggggcgctggctttgcccccagtcgccgttactcatcttcggtggtgggacggggaggacgccttgtcgccccccttctggtccggggtcttacgcggctggcggcggcagccgccgagagataaggggggcacgtgtgtgcctccgcctctcctctgtctgggccgccgccgccgcttgcccgcctggaaggagagggggtagtccgcggactgcgtctgcgggggcaggaagtctcaaccttctgggctcgggccgcggtgtcgatatccgatggcctttccctctcttcctcgtatgctccttctcctcctcctcctcctcccggcacgcccctgagatctgcctcccctccctctccctcgtcctggtcggaaaagtctgaggaggaaaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcagcgagaaccgaggggcttctgggggtgactgtgatctgttccggatttaggtccatggcgggtgtgtatgttttaataggggtggtctctggcgcggcaggatgatggtcgaggacgtccaccagggccttgcagatgcgcttgcctagatacaggatgtcgtccatgctgaggggagggggggtgtctgctcccccctgcagaagccgcctgggtgcgggggtgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgaggtccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggagtatgaaacgctcttttccttcaccgctaccaccgcctcctcctcctcttccgtcgccagagggatctgcacccccccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccactgccgccgtccactgccttctcccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgccgctttcttcaccctctcccccgccggccccacccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggaggccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggcggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggaggatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactacggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgctggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccacgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtggccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttgggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcagcgtgaccgtcttgtcctgtaggtcccacttctttctgggaatcacaaacgatgccgaggtaggggttatgaccacgctggagggctgtgcaggtatggcgtgggccggagttggatcttcatcctcctcctctgaggatgaaatctctccatctgtggagtgttcttcgctgccgtccatagggtccatatcgcagtctgtgttggtgtctgagaccgcttcgagttccagaatgtggctctctgcagaggggagacaaaaggtggagactgccttgagcacctctatctcaggcaccggatgcccccggctccacggccccggcccctggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtagggtgtgatgacgacgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggggcccttgatctttagatccaggtccaggaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggacgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccacgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagtgcggatctctcgcgagtcccgccgcagcttctcgtgtgcaaagtgggcaaaagcctctgtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgcttcttggcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggcgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatccaggatggcctccgcaatgtcagtgtttgaggccacaagggccttgatgacgacgggggtggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgccgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattgataaaacaagggatatgaaggtgtcattgacccgaggatccaaaccccctcccctgtctcccctcgagcgcctcgctcagcccactatcacccatggccaggcccggcacctcctcgaaggcgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtctgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagggggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggtgcggaaatcagttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccctaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtcgacaagttacgcctgaaggcgcagtccgccatgaccagcagcagcagaagggtcagcacagccagagatgcccactgcagtactagcatggagaggtttgagaatctgggctgggacgttggcgggacaggcacggtggcttgggctgtggtaaccggtgggctcgtaaaagtccagcggggccgcagtttgctagaagtgctgggaggtagataggtggtcgcattgtatctcggtcttggcgtagttgaatcatcgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcatttttggggggcgtgcctttggtgacattaacctcccccggttttgtggatgtggaactgtttccagggcctgacgcttggctggtggtgcctgggcggggcgctggcgaactggtggacacatgatgtgtgctgatagaggctggtgtcacctgtgttatattttcaccacctgttgggtgagcggaggttagtaaaggcatatgtgacgttgtctctgggattgaactgggtctcagtgacatggaagaggttgaacttgaagttctgttatgttggcctgtggtaacatcactggttgcattttttggtgggctggtaactactggggtgggacttgttcctcctaaggtgtggttggtggcatttgcctgtggacttgtttctcccacagtagggctggtggcatttggggttggggtagtcactgctggggtggggctggtggcatttggggttggggtagtcactgctgaggtgggacttgtttttcccaaggtggggctggtggcatttggggttggggtagtcattgctggggtggggctggtgccatttggggttggggtagtcactgctgatgtggggctggtcatgtcgggggccttactttctgtgccgttgtcccgtggagatggacttggtgtcaccggtgatgcgcctgacgttgtgccggctggtgttgggctggtgacatccgctgtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgttttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttgtgtttttacgctgaaattcgagtcttgagctgacgttggcaaacttaagggtaacgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtacaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaacgtcctcatagagttatcagatagcagctcagaaaaggaagcagaagatgcccacctggagccagcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaggtgtgtgatgtgtgtttttacccatcacacaacaagaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcaacacttgggtgcacaggtggccgtaggtgtcacgtgaccttttccgccggcacctttaagccgccgcgatgtacccccggggatcgccagtggttgtatgttcagagctccgtgggtaacattgtacagagctgtaatccccgctacagtattttctttgactatatggctatacacaggagcctcacgaaaatctgggaggaaattttaacacctgaccagcgtgtttcatttatggaattcctaggatttttgcagagaacggatttgtcctatatcaagaactttgtcagcgatgccctgggcaccactagtatccaaacaccgtggatcgatgacaatcctagcacggagacggcacaggcttggaatgccggctttctccggggtcgtgcgtatgggctagacttgcttagaactgaaggggaacatgtcgaaggtgctaccggtgaaacgcgggaagaaagtgaggacgcggagagcgatggagatgatgaagatcttccttgtatagtgtccagaggtggacctaaggtcaaacgaccccctatatttataagacgtctgcacaggttgttgctgatgagagcgggcaaacgaacggaacagggcaaggaggtactggaaaaggcccgtgggagcacttatggcacacctaggccacctgttccgaaaccaagaccagaggtcccacaaagcgacgagacagctaccagtcacgggtcggcgcaagtcccagaacccccaaccatccacctagcagctcagggaatggcatacacattacatgaacaacacggcatggccccgtgtccggtagcccaggccccacctacgcccttgccccctgtatctccaggggaccaactcccaggtgtttctagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagtttgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccacccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacccgagcggtggatgttcccaggtgccgccctgagccagagtgttaggccaggggtagcgcagtcacaatattttgacctccccttaactcaacccattaaccatggggcacccgcagcccatttcctccatcagccgccaatggaggggccgtgggtacccgagcagtggatgttccaaggtgccccccctagccaaggcactgacgtggtccaacatcagctggatgctttggggtatgcactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtggaatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattaattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgtgggcaggccatgaatattgaggctcctagactgccagatgatcctataattgttgaggatgacgacgaaagtgaggaaattgaagctgaaagcgacgaggaagaagacaagagtggaatggaatctcttaaaaatataccgcaaacactgccgtacaatccaacagtatacggcaggcccgcggtgtttaaccgaaagtcagatgcaaaatcaaccaaaaaatgcagggccatagtaactgactttagtgtaatcaatgccattgaagaggaacacagaaagaagaaggcagccagaacagagcagccaagagccacgcctgaatcccaggcccccacagtggtcctccagcgaccacccacgcagcaagagcctggccccgccggcccactgagtgtccaggctcggctggagccatggcaacctttgcctgggccccaagtgacaacagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaacacgtctcaacttagcagttcggcaccaagctgcgcacaaactccatggccggtggttcagccaagtcagactccagatgacccaacgaaacagtcccggccaccggaaacagctgccccacgccagtggccaatgccactgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgaagataccaccgagagcgcccactcccatgtcaccacctgaggtgccgcccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcgggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacggggggggctcgcactctcccgtcgttatcttggagaatgtcagccgggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctatacagtcacccgacaatgagcggggagatgatgtacagactaccggtgagcatgatcaggaccctgggccggggcctccatccagtggggcttctgagggattggtaccagaagagtcagactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatatatcgcaaggaatatcagggatgccgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacgtcttgtgcttcgtgatggcagccaggcagcgtcttcaggacattcgacgtggacccttggttgcggagggcggtgtgggttggcgacattggcttctgacatctcccagccaatcctggcccatgggatatcgtacagcaacactacgcacattaactcccgtgcctaacagggttggggctgacagcatcatgttaactgctacatttggatgccacaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaccatgtaatccagaacgcatttcgaaaggcacaactacagggtttatcaatgttagcaacgggaggtgaacccagaggtgatgctactagtgagacgagcagcgatgaggacaccggtagacagggttcggacgtggagctagagtcctcggacgatgagctgccatatatcgatcccaatatggagccggttcagcagaggcccgtcatgtttgtgagccgtgtgcctgcaaaaaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccaccctaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgcggggcctcctgccgcggggcctcctgccgcggggcctcctgccgcggggcctcctgccgcggggcctcctgccgcggggcctcctgccgcggggcctcctgccgcggggcctcgtataatggcgcctcccgtcgtacgtatgtttatgagggagcgacagctcccccagtccaccggccgtaaacctcagtgcttctgggaaatgcgggctggtggtgaaattacacaaatgcaacaagaaccaagttcacacctgcagtccgccactcagcctacaacgcctcgcccatcatgggccccatcagtctgtgccctctcggtgatggatgctggtaaggcccagcccatacaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccggccccccgggctccataccagggataccaggagccgccggcccccgggctccaatcatcttcatatccaggatatgcgggtccctggaccccaagatctcaacatccatgttataggcacccctgggcaccatggtctcaagatcccgtgcatgggcacacccagggtccatgggatccaagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccacctccccctatgccgttacaagatagcatggccgtggggtgcgactcatcaggtacagcatgcccaagcatgccctttgccagtgattacagtcaaggtgcatttaccccactggacattaatgccaccacgccaaaaaggcctcgagtagaagaaagttctcacggacccgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggctgtcttgttaaagttaaccggcggtggaggatccaccggccagacctctacatttggtttgggaacccaggtgatggccgcggctgccacccgccctcctcctcttaccctgggtggcaaaaagtatgccaggagtagaacaataacaagtgcgatggcggtaaacaatggcaccctcacctgcttaaacgaaaccatggcaaccacttcaaagagagccaacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagaagccacctgcggacaaaaatcaggcgtttagatggggcattttatgtttgggccattagccacctgggcattcgtgttactgtatactgacctcacggtagtgctgcagcagatgcttaaacttggcccggcattttctggaagccacccgattcttgtatcgctttatttctagttcagaatcgcattcctccagctgcgagcaagggaatgcgttactacaagtggtgcctagtcagttgaaacaggccccaccgtccgctgccgccctccttgagccccaccgtccgctgccgccctccttgatcccctccttaccgattctggctgtagtggtttccttgtacgtcgtgccggggcagccgctggtgcaggctgtggagcaccaatgtctgctagctgttgttcttggttagccccggggcaagccaacaccactgctgctgctggttgaacagtagaattgtctccaggttgaggtgcttctcccccggcttggttagtcagttgattctgggttatgtctgagactgggaacagctgaggtgctgcataagcttgataagcattctcaggagcaggctgaggggcaggaaaccacgacccagttggtgcggctgaaacatgataggcagtgagctggccttgtggcagaggctctggcagcaccggccacagcacacaaggcaaaggagcttgtgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctctgaggcacattagcaatgcctgtggctcatgcatagtttccaaaagaggaggaggcagttttcagaagtgtctaaaataagctggtgtcaaaaatagacagcccagttgaaatatgcatggcatgcagcagacattcatcatttagaaatgtatccaagatttcattaagttctggggtcaggggggagtccagattcaaatcctctgtcatggactctagtgttgtggtcagttcgtccaaatggccacgagggggcgggtggttcaggtccatctgtccacatatggctgcttcctccttctggggaataacagtgtcagccatctcccttagggccttcacggcctgactggtttcctcatcagggtcctccaacagatgacttgcctcgggggttactgcgggggccgggtcaagtggcttgggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttcctccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaatgccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacgcccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcatgaaatccctgacctcgatgactccgatgctgttttcgcacgcaccttattggcagccttatttcacctcaatatgttctttattctcaaagattacataacacaagactccatgagcttgaagcaggcccttagtggtcattggatgtctgccacgggcaaccccctgcctgcagcaccggagaccctgcgaaactacttggaagctttccgaaattcggataatcacttttatctcccaacgacagggcctttaaacaccttcaaatttcccgaagagcttctggggcgcgttgttgtgattgattcctctttgtgtgccgccagtcacgttcaggacgttatcacccgtggtggtggggcgggtgttcctcgtcctaggtttttggccctgcccccggccccatcccgtgagccccagcagacatgctctcagttaacgagcagagggaatgaaagctcacggcgaaacttgggccagcccggggggacctcccccgctgttcccccagtttgccccatcgtttccctggcagcctcccgggccaagcaaaaccgcgggggcacgggatccttgcacttagcccagcctgagggaacctcccccgccgtctccccagtatgccccatcgcttccccagcggcctccaggtccaagcagcaccgcggggtcactggatcctcacaggcctcacccagctcttcttccgttgccccagtagcatctctgtctggtgaccttgaagaggaagaggaggggtcccgagaatccccatccctaccgtccagcaaaaagggggccgaggaatttgaggcctggcttgaggctcaggatgcaaatcttgaggatgttcagcgagagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggacagaaggaagactcatctggaccagaaggctccggcggcagtggacctcaaagaagagggggggataaccatggacgaggacggggaagaggacgaggacgaggaggcggaagaccaggagctccgggcggctcaggatcagggccaagacatagagatggtgtccggagaccccaaaaacgtccaagttgcattggctgcaaaggggcccacggtggaacaggaacaggaggggcaggaggggcaggagccggaggggcaggaggggcaggagccggaggggcaggaggggcaggagcaggaggggcaggaggggcaggagccggaggggcaggaggggcaggagccggaggggcaggaggggcaggagccggaggggcaggaggggcaggagccggaggggcaggaggggcaggagccggaggggctggaggggcaggagccggaggggcaggaggggcaggagccggaggggctggaggggctggaggggcaggagcaggaggggcaggagccggaggggctggaggggctggaggggcaggagcaggaggggcaggaggggcaggagcaggaggggcaggaggggcaggaggggcaggagcaggaggggcaggaggggcaggaggggcaggagcaggaggggcaggagcaggaggggcaggaggggcaggagcaggaggggcaggagcaggaggggcaggaggggcaggagcaggaggggcgggagcaggaggggcaggaggggcaggagcaggaggggcgggagcgggaggggcaggaggggcaggagcaggaggggcgggagcgggaggggcaggaggggcaggagcaggaggggcgggagcaggaggggcaggaggggcgggagcaggaggggcaggaggggcaggagcaggaggggcaggaggggcaggaggtggaggggcaggaggggcaggaggtggaggccggggtcgaggaggcagtggaggccggggtcgaggaggcagtggaggccggggtcgaggaggtagtggaggccgccggggtagaggacgtgaaagagccagggggaggagtcgtgaaagagccagggggagaggtcgtggacgtggtgaaaagaggcccaggagtcccagtagtcagtcatcatcatccgggtctccaccgcgcaggccccctccaggtagaaggccatttttccaccctgtaggggatgccgattattttgaatacctccaagaaggtggcccagatggtgagcctgacgtgcccccgggagcgatagagcagggccccacagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagttctcctggctaggagtcacgtagaaaggactaccgaggaaggaaattgggtcgccggtgtgttcgtatatggaggtagtaagacctccctttacaacctcaggcgaggaattgcccttgctgttccacaatgtcgtattacaccattgagtcgtctcccctttggaatggcccctggacccggcccacaacctggcccactaagggagtccattgtctgttatttcatggtctttttacaaactcatatatttgctgaggttttgaaggatgcgattaaggaccttgttatgacaaagcccgctcctacctgcaatatcaaggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccacctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagtctggcctccttaaattcacctaagaatgggagcaaccagctggtcatcagccgctgcgcaaacggactcaacgtggtctccttctttatctccatcctgaagcgaagcagctccgccctcacgagccatctccgtgagttgttaaccaccctggagtctctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccattattgcctgtgtccgacgcctgcggactcaggccaccgtctacccggaggaggacatgtgcatggcctgggcccgcttttgcgacccctctgatattaaggtggttattttgggccaggacccctatcacgggggtcaagcaaacggcctggcattcagcgtcgcatacggctttccagtcccccccagcctgaggaacatctacgcggagctgcaccggagtctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcataactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgatgaagacccatccgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttccgcaatccaccaaagacaaggttcccaatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggctttggctatggtcatggccagctttgagctaatgccatagtcacggatgctgcagaggttcagggacttgtcctctatagtctcatacagcttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgccgccgtaaatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacactgagctgtgcttcacgtaggtgacattgtaggtgaccttgacccgttcttcatcctgctcggttcccaccgggaccatgtcttggtcggcgaactgcgagtagttaccgaggcgtgcataattcttttggagccaggtgtgggccgtgaggcccggaagaccgaccagggtcttgtactgggccaggggatcgaggaagacctcgcactccaccgggcaggtaaacatggtcaccccgcccccatctcccccagttccccgcgcggcgcgcccctgcccggcagtcttgagcgtggcgtggagggtggtgaggaaggtcttgacctcggcgtgggagaggaagagccgggtccagcccacgtactgcgtggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtgcgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgagaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgtaggacgcggcgcttagccagggtccctatcctcctgactatacgcctcacggaggcgtctgaggtcatgtttaacatgaacgtggacgagagcgcctctggcgccctcggctcctcggccattcctgtgcaccccacaccggcctcggtccgactttttgagatcctgcagggaaagtacgcctacgtccagggacagaccatctacgccaacctccgtaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccattaggagtatcgggacggaattatatgaggcaacgagggaaataatagagtcgctcaactccacgttcatcccccagtttacggaggtgaccatcgagtaccttccgaggagcgacgagtacgtggcctactacggtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcgcagcgcaaggaccccaagaaggagctgctgaacctgctggtcaagctctcggagaacaagaccatcagcggggtcacggacgtggtggaggaattcataacggatgcctccaacaacctggtggaccgcaaccgtctatttggccagcccggggagacggctgcgcagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcagtacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcaagcgcgaccgggggagatcatggcatccggcaagcaccatcagcccggggggacgcggagcctgaccatgcaaaaagtaagcctgcgcgtgaccccccgcctggtgctggaagttaaccgccataacgccatctgcgtggccaccaacgtccctgagttctacaatgccaggggggaccttaacgtccgagacctccgggcccacgtcaaggcccggatgatctcgtcccagttttgcggctacatcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaacggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttttgacctcggggaagatggggtgcctggccaggtcacccaaggattactgcgcggatctaaacaaggaggaagatgccaactcgggcttcacatttaacctgttttatcaagattctttattgaccaagcatttccagtgccagactgtcctccagaccttgagacgcaagtgcctcgggagtgacacggtctcaaaaataattccctagaataaactgagaacagtcatcagtaaatctgtctctcgagtgatttccataggcatggcgtagccggggtggagggccgatatcacatcaagcagaaaggccataatctctcgaaagtaggcggtggggctgagaccatgctcagtggccgtctggcagggggccgggcgcgctccatccttgtccaggagacacacgtggcttccagagaggcgcagcccagccctccgcagccgctgaagccaggctcgcggaagagcccaaaacctgtttcggcgccgcccaggggccagtctccgggtcaggtcgcggaccagggtcaacaggtggtcgtgggatggcggggccttgtctgcctcgggtctcgccgctagttggtccagggtccaggagaaggcttcgtgccagaccaaaaagggccccgagtgctccctacatccacccacgtaaagatccccctgaaagatggccatcagtaggcacgcgggcccgcgtcgagccttcacccgaatgtgtctgcgggccacggtggcctctccgcccataacatcccggtcgagccggctggcatcctccgagtctttcacaccttgcaggaaagcctaggtgatacagcaacagaaagctattagctggtggttcccccaccatcattcttcctgttaacgggaagaataagagttgggcaaaccccgggggccgcgctctcccacccagccccgctcctcacctgtgctagtggctcctctgaaggatgggcggaggttgttgccacaaagcccaggatgaactcgtctgcataagcccaggtcagtcctaggtcagcggccgcgtggaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacaggggcgcccctggcagagaggtggcagcgggccaattcgtagagccaccaagtggcatcagcctcaaggatggctgtggcctccgcgcgcccaaccaccgtcgtctcgtcctccccccctccctcgccgccctcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcgagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccacctcggacccgaagccatcaccaggtgggggttgttggtcccgcccatcatcccccgagcagctttggcagaccacctgtgctggaaagagaggctggaagatgaggccctgctcatcctccacccgggcagcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtgacattataaaaggtaaccgagctgacccgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctcccaaccgtgctgtttttggccatcctcaagctctggtccatacaggtcttcatccaggtcctttcctacaagcacgtctttctctcggcctttgtgtactttttgcactttctggcctcagttctacatgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcatgcggcacaactttggcttctactgcggcatgttcatcgcctccatcatcctgatcctgcccttggtcaggtacgaggccgtctttgtctcagccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacaacagacagcgaggaggagatcttcccctaatgcaataaaaacttaaaacactgaggttactttcccgtcattctttcgggggaacgaggggaggcgggaattgggttaagataggggcgaagggtggggtgggtgcgagaattggggctggggagggagaggggagtggcctcggtgccgacgccggggtaccaagataatggattgagtaagcatggtgctctgatcgggtccgccgggttctcgggggtgtagtgggtgggcattgcatatttttgccgcggtgctgttgggccttggactcggggtgatcacccgcaccctcacccgcacccgcaccccagtccacagccaccggccaaggtcctgggcctcccaccaccgttatgcctccccctttacccattaattacaagagatgttagtttggtttttatttggcaaaaacagcaattcatcattttcagagtcctcatcatattcgagcccctcgttggtttccccgcaggccctcccttcttcgaccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaactctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggcaacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtcctggctgtcattctcttggactaacgaggagacaaagtcacagaagccagtttcaccagagaactcttgtatttgtttacagaggcaatagagatagacatagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctccccatgccccacatggtgtctgtgaaatccaccaggatgttgctggggctaatgtccgaatggaagaggccgcagtgccgattcaaaaagtaaacggcatctttgaggccctgaaagccccgcaccaggggctcaatactaccatcatgccagtggccataatcctggagactgcatctgaactgaggcataaacagggcgtggcaggacgtgcaggccgacaggtagtccaccagggccttgtcctgcccgtcctcggccgtggccttcccaatctgaatcatgtcacacaccatgagctcgtgatacagctccgtcacagagtcatagagtttgactgtggcattatctgcatgtgcatacacggccccgtagctcccccgccccagcagatactcgcaggtaatggggaggtgatcacagcgcgtcatgttctccggcagctttacatagagggtttccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgcggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagccgagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggcccctcttgccccgtgctgcagcgtaaacacagtgacgctcttcgcagtgggacctggggccgtagaagagggcccacatccaagggagtgggtcttcaggcaccagggaggtccaggtatgggagtgggccaatatttgcaaggcctgacctataacctcatctttgttccaggccagcgcaattcgcataaggtccccatcaaacacctcaaaacacagacccatgcccatttcaggctgagagggctccatccggctcgaccacccttgtccaccaaactgccattcttctggtaaacgggggttgaggggcaagagctccaaagccaggctcgagaagtcatagtcatcctcggccacacggccggagctccgggcctcgtgccagggcctgttgtcctgagggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacgggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccccgcccttcacaccccagtccaggtccagatgtgcctactaccagagctacgcgacacgttactgcgcctgctgcccccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcgggttggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacgcgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccaccgggggacctggagtcgatcaccttaccccaggccgaggccccttcctcatacagcgggtggctatctatccataggcaggcatccggcgtctttggtgcattggagatagctttcacccaacaactttcccaactaacccgtcgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagggtgcccccgacccgacacccacagtgccgccagtccctgctcggcctccgccgccttccccaccggcgctgccccggatgttgctggggttctcgagggctgggtggtgcttgggcacagaggtctcagcagccgccttggtctcggccccggccctaagtctgagtcccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgatcagatgcccgtcggtcagagcgcttttggccccctcaaagagagacaggtaataaatctgtagctccccaaccagccctccttcatcgtaaaatcgaagggcggccacgtggaaggggttgtagagctctggaaggccctcctcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagggccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgactcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatctgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacgggacctacacctacaccggcaagcagcgcaacctctctgacgacgtgttggttgcgctagtcatggctcattttctcgcaacaacacagaagcacacgttcaagaaagttcattaaactttattgactacaccagtcccttgtaaagcgatgggtctcgcgtgacggcattcgtgagcagggcttcgtccaggggcttgttcttggtggacatcattagcccagctgcaaatatcagaattagcattagaaaagtgagtcccacaaacaccagtgtccagagaggaagaccgtaagataaagatggctgcctctcatctggaacggtgggaagctcagcagttgtttttgtggcattggacgtccctttggaggacagcgtgggggccaaggtggtagcgtttgtaatccgtgtagtagcactggcggtggtggaggacctggtggtgacattgctagtcacgcccgtggaggttcctgttccggactcggtggcagtgatgttctgtgcagtgaccttagtggtgacattgatggtggatgcgttggaagttgttgggactggtgtgacagttgtcccagtggatgtcaccgtggttgtgttggtgctcaggagagcagtcgtggttataggggcgctggtcgtggtcaaggtcgtagactggtttgtgctaggacccgatgccgatggtgatggtgtagtcacagccgttgtgcctgtcacgttccccgccgaggccgtcgaactgccactagatgtccagataaggcttgtctcacagatgagtatcatggccaggacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcgcggcccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcactcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgtgtccgggtggtctgattctgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatctcctggaagagattcaagaggtcgtgatgctcatgccggataaggcctcggaccaggcgcatacttgccctgggcagcagggtcaccatgatgcaaaagtagagactcagattgtccagcagggccaagccaaggggccccggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaacaccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagccccctgttgttgcgcagaagctcctccttgttgaaaaatgcccggcaggggctgtagaggcctgggacggccgtctggcgataggaggagttgtacatgatgtcgcccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagtgtcccattgcgctgagcgcccaccttggccttgatgtagtcgttgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctgacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaagcgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcatggaagagacactgggtgacagcccgggtcctctcggagaaggcaaaggccaccagcccgttcaccaaaacagtctgctctgtccgcttgtcggcgggattcggggccagctgctgcgtaacgtcattgtccaccgacacacgcacggcgcgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggtcgggaggaaaacgtagtaaaagatcttttccagcacatccgcatgcccctcatctacataagggcctaggtgcagacggaaatcgtggtcgtggtccccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagtatgggtgaaaatgtctgtgtaggccaccggggggagcaggttagggtccaggagtgcgcagacatactgacccacgctctcatcccccacaacatctgacccggccaggcgcatcagggcctgctctagggctataagttccccatagatttttctatacatggaataggcctccttggagatggcgttatttcccaggtgacggcagatgaacttgatcatggaaaagctgttcacaaaggcaagcctccctgcccgttcccagtaggtgttgatgcacagggacaccaaaggcacgttcatgacaaacttttcctcaaacccgtggatcatagcctcaactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacggccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtatacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccatgatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcgtggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattctgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacagcccctcggccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacctgcacttcccgaggatgctacccttctaatcaaatggttggacacggccctgggcagggaggccaccttttacgcgtgtcgggctatgcgtcgtcttctactcggcgttatccgaataaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataagcacgagctcaatgtttcgccttatcatccgctacttgtctcatcaccaatttgagcgctgcttcgagcagttctgccgcgtggtcccgcgtcgcttcctagggacctgtaagcaaaactctgcaaagatgctggctcatctgaagcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggacactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcctgcgagcttccagttcccctcctccccaaccggcgccctattgcgatgcatagttgctgcggccctgctgccggaggtgtccgtggggcaccaggagctgtctccgctcaggtccagaagccagggaaggcagacggatgtcaggtcgggcccggacccggcacggaggctggtggccctcctgcgaagggaagatggggcacctaaggacccccctctgggaccgtttggacacccccgggggcccggcccggccaagagcgaagacgaggagtctgagcgtcgagacgcccctccacccccgctcgatttcagcttccaagcttcccggttggtgcccgtggggcctgggtttcgcctgctcgtgttcaacaccaatagggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccaggacggtctcaacgtgtcctggtttaaggccgcaactgccaccatatctcgagtgcacgggcggacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagcttgttgtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccaccgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagaacaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaagacaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctcccagtctgataccatcagtgaggctgaaaccaaggcctttgagaagctggtagagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaaccggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacgttgatgagcgggataatcatcagaactttgtcgagcctgtccacgcatttgtaggcggggagatgccacgcatccctgtcttctcgctccaaagagagacgcccaagaaacccatccacagcatttgaaacggccgcctggtccagcattgcctcctggggggccatgctcagcagcttgtctcgtgtgaggtcaaatcgtaggctgaggtagcacggtgagaagagcccgctctccgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtcgtcaggtgaccaagctcctccatcttgaccgtggccatcagcatggcggccaagcgctccagcccgtaggattgcatgcccttgaccgtggccccataacatatgccgatgatgtctttcaggacagtcagctcaaagaagctcttggccaaccagcggaggtccacgcagccattgccagtctcacccacggcatgacccaccttaaagaaggccacagaaacctcaaacatggtagtcagcgtttccgtgtccagttctggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagatcaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctaaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtagtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgtcaggtgggtcacaattggaacccgcgtgctctccttcctctgagccttggcctggcgggtgtcttgggcatcatccagattcagaacattcatcacactcccacttagccgcttcagctgggcagcatgcttggataacttactaaactcacgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccagccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgccggtggctgggctcccctgggtagggtaaaggggcacgatgtgtgccggctacccggagagtttccagtattagatgtcacggcagcctgggtccggcacggcaccctctccccagacagtccggtcggagccatcaaggggggccagtgggtgggcacctggtagagtccgtcatcatcttcctcacctgcccctgagtcactgccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccgaggtctgtgtgccctctccacgcacgacctggcaaaatttcacagtctccccccggctagaaaggcggcaggtaagcgagcgcaccttaggtgttactccaagctgctctctcttaagagctgggagcaactagcctcttttttgtctctgcccccgggacccacgtttacggactttagactatttttcgaagtcaccctgggtcggagaatcgcagattgcgttgtggtagctctgcagccttccccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctcggcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtaccggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgctgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcgatgcagcggcgcaagcctgccgtggcgtcagctggcatgccgggcgcctatccagtccagacgcttttccgccatggggagctcttccgcttcatctgggcccactacgtgaggcccacggtggcggcagacccccaggcctccatcagctctctttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcggccctcgcccacgcttgcggcgcgggagatcctggagcgtcaattctccgcctcggatgactacgaccggttgtacttcctgacgctgggctacctggcctcccctgtggccccaagctgagccagttcctcgcactggagtgggtcattggcaaagaggtaaataaagtcatcgcacgggggttttgcctccttctcgtctcttgtttcgggtaggggagtaaggccgtgccaggccgccatgctcagggccacggcgtgccagaggccctcgtagtcgtgcgcatccgagaggatggcacggtccagaagcagatagccggccaggcagaggaaggccacaaagagggggcgaaggcgggcccgaacccgggtttcatgctcatctgccccccagtgaacaaggcagtagaggacacccaccaccaggcggttagggaggacactgccaaggttgaagagcagatttccgtcagccagggtgacctggctcaggtccggcgccctgcgcagtccaagctgcgcccacacacatgcacagacggcccctgtgacatcaggccggtcatgcaaaaacagacaaagagaccgtgagcggttaccggggcgcagggcctctgccgggaagcccacccgtgccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgaacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccatgtgtctatctgtgccctgggtcgccggcgcggcaccacggcagtctacggtacagaccttgcgtgggtcctgaagcactttagtgacctggaaccgtctatcgccgcccagattgagaatgacgccaatgctgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcaaaccccgctaccctacgcggccccgctgccccccttttcccaccaggcaatagccaccgcgccttcctacggtcctggggccggagcggtctccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcgggggactattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccacccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccacccccgcggaaagaaactggtgcaggcctctgcatccggagtggctcagtctaaggagcccaccacccccaaggccaagtctgtgtcagcccacctcaagtccatcttttgcgaggaattgctgaataaacgcgtggcttgaaagtaaactttattgcgtgttagtaactgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagcgtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatacgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtggggggaaggagctgacacgagtgcgtagaaagggccaaaaatacaccagctataaggaattgctcaggccaaagttgttcctcaggtggctttaggcctaatgtaggcaattgcgtgcctagaacattgctaatgtgccctgtgtttcctgccttcatgcaaatatcctacctcccccggcctggtgcaaaatgtctgcctcagaatactaacagctaatccaagctaacattctatcagtaaacgggcagaaaacggataaggaccgcggagtttggccctccgcggtgtccggtggtcctcacacgtgccccccccgggccgatggctgaggcccggaatatgcaagtgcatctttctaaccagtaggggcctccacctaggtgctttgttaatctttagtgggaactagtgggagtgctgtgcctagggtacccctatcctagaggtcctaccggagctccttgtcttgataatccctgtaaacacacaccacctaagaacaaggcatcgttaacctttggtggaacctagtgttagtgttgtgctgtaaataagtgtccagcgcaccactagtcaccaggtgtcaccggaggctacttgcctcagtgccacttttaccttctcaaatctatacgggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctgtatagtcacgaccccaccgaaccaggcatgatgtagaataaaattttatgcatcgtcttctaatctgtgccgcttggagggaaacatgaccacctgaagtctgttaaccaggtcagtggttttgtttccttgatagagacacaaggactgccagccccgttggggagggggtggtgggtacgggagaatttgggctcgtttaaacaaagcctcctctgatgctctgtggcacctcaaggtgaatatagctgcccatcgacgtatcgctggaaaccggtgggccgctgttcacctaaagtgacgcaaggtctgtcagccgccagggtccgtttaccaggctttcaggtgtggaatttagatagagtgggtgtgtgctcttgtttaattacaccaagatcaccaccctctatccatatcccacaattgataaacctccgcatgtccaaccaccacgttgaacaggatgtggcaccctaagaggacgcaggcatacaaggttattacctagtccttgtatgcctggtgtccccttagtgggacgcaggcctaggtagcatcatttacactaaaagcagtgaccttgttggtactttaaggttggtccaatccataggcttttgtgaaaacccggggatcggactagccttagagtaactcaaggccaagcatttcacacctgcaaatgcaccatgtaaccacagatctaaactgaaagttgcagctttagatggcaaggaaacttgggtttcaggcatagaaagcctggctcactatagcagcccatgtttgttccagggtgggggaaaggcacatgcccttagaaaacttagctgcaaaaattctattgtgttgggagagcctccatatctaaaggcctttcctcacaatacaaatgttactaacgtctgccctctggagacctgctatgtggctagacgtatggcctacccaagacgttgggggtctcgggtaggccatgattcttccaggcataggttacaaccagtcactgctatcaagcctactcagttcccaacgcagcacataccccccgcctctcctgccatgaggacttatggcagtgtttactgttctgcttttactcttggaccaggctgtcattctatcagaataacaggggaagcaaggccccctgcgtcagcgggacacgtgtttctagaatctcggagccaataactacctgcccctctaatctgtatgctgcatgaaaaaccacatacacgtgatgtaagtttagccagtttattgttacaccaatgccccgaaagtctccccctgtcgctttgggtctcaggacccagccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccggggttccggccctggagctcggggggcggccgggtggcccaccgggtccgctgggtccgctgccccgctgcggcgggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgccccgctccggcggggatgggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggtcattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccatgatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggccccccgcgtgccttcctgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaagctggattttggccagtcttcaattttggggagtggttttgtgtgagccggaagttggcaatggggtgagggcggcgctggttaagctgacgacctcccaaggtctctcaccctgggtacacaggtggggcggcagcctctaactttggctgtggcctctatttcctccctttcctagccagggccatgtgttcctgcatgtctacttgcctcctgtggtggcagagcttggccctgggcccaacccccgccttgggagcctgtaggggccaacacccttggtttgtttgtgttcctgtttgctggcaacttactggcagccgagcagattctaatgggcgcccgccttctttctctcttgttttattaatagaatctcagccaggacctatacctgagacttcaaagtctggtcctgggttctgagacccccaagatttgtcatgcacacctgcacacctgttggtattgggtttctattcttgagtgtgaaagtttgtaaaaaaattcataaaatgtcactaattcctcttacctgtttagggtattgtgcaattcttcagcctgcctattttcaatttgcctaaggtggcaatttaagatgtggttaattaaccattttcctgtctgacaccactgcatgggcaaccgggttccatggcacatttagagataaacatagatgtcttgtcttgctcatgtgcagaggagggggtgttggtgtgcaatatagtttctggattccaaattgagttgggggtgctattttcactatggaattaaattactgacattagacagtggacaccgggctatatgtggggatgtctgtggcttgtcatttcctcttagaaggtaatcccccatcttaacttccctttaaattgtgatgcaagccctgggttatttatagaatgattatctaggtttgatagtctgaaggctgggcagagaatgtttgtaatttttattcaccttctttaccccccacgagtatccagttctagaagatctcctgatatcccgggctgccattattcccttgagtgttatagcttcctcttaacttaagcaagagctccaggatgttagcttttttggtggggctggttgtcaggaagaggttccagtgttgtcctttatttttagatgttagctttgtgttgggttagtatgggctgggtattcactagtgaaggcaactaacacagttagacgtgctagttgtgcccactggtgtttatccggtcccaaatgtcaccacagaacacaggaggctggatttggcagcagcacttgtgcttttgttgatttttacccgtgtatcagagttgggggatgctagccaatttagcttcccctccccttaacagggggtctcgcggggtgccaattgtcgcctgccttcccctgcttccccttgttaacttatagcatgataggtaggtcacccaacgtggaagcctggtgggtgatccttcctcggtagggagcgcttagggctgttgagctcaagagccccacctgggtaaaatgtatgttctaaagagttacccaattataacaaaaatgttgtagggtaacgaagacctaatggaagtggtattgttgccgttgaaagacgggtgtcctggctcaagttcgcacttcctatacagtgttaaagccttgtatcggaagtttgggcttcgtcccagtgtactcgataatgtcgactgctgcgaaggtttgggccgtcttccagtaggtgttgggggtccccaatcatgaggttaggcaggtgcacttagctctttagggacccttaagccagacaatgtagtgcccctttttttgcaaattggccttattattaatttcttgttaacactaattctgttctatgaccccgtgttttcagatgccattgggcgtgtcactgagctgaatttggacgcagctacttgacctttgcccccgtgcctccagcgctgataagtgctgcgtccactttgtgttacaggtgggccaaacctccagaatatcaattggtggggccttggtgggctgcataaggcagtaggtttgaggtgacctacttggaccatgtggatccagtgtcctgatcctggaccttgactatgaaacaattctaaaaaaatgcatcatagtccagtgtccagggacagtgcactcggaagtctcatcatctccgtttgtgtgtttagtgtggccagtacggccactcctgtgccacgccctggcatgctgctgacatctgggcgccaatttcagcgggcccttttcccccttgtttaccccatagcaagaagggtaggttacatgggtattttcccatcagcacctgactggccggtgtaattagaggagagggcaacaacgcaaggctgttgttttatttgggttacaagacctgcggcggtcaatgggtttactgattacggtttcctagattgtacagatgaactagaactgtcacaatctatggggtcgtagacagtgtgcttaccagacttccatggaagatgtgaatttgctgctagctatatgggtggcgctatgggctccctagggactcatgtagtggggctttgtgatagctaatgaatgtggcagctgttgtttgtactggaccctgaattggaaacagtaacttggattctgtaacacttcatgggtcccgtagtgacaactatgctgaatatcttgaatatgggaggagggggggctttgggtttcattgtgtgccctttcctgtccaacgtgagggttctagtgttatagggcgtggcagtgtttcttgagggctaatatcacgggtgaggcggttgtcacaggtgctagaccctggagttgaaccagtaccactcggttacaaagtcatggtctagtagttgtgaccctgcaaagctacgtggggatgagcagccagggactttggttgacaagcagacaggcggcgcattggaaccccagaggaatgtcccggggccacctctttggttctgtacatattttgttattgtacataaccatggagttggctgtggtgcactccatctggtaaggggggctggtgcggacgcctgtgtttagtctatgccaatgtttacctgccttgggttactattccaaacgaccacacctttaaggacacctggagccctgatcattctcggcttttactgccacctggcttctgttgggtcagacagtttggtgcgctagttgtgtgcttagcagcaacgcacaccaggctgactgccttagcagtgtggtcctttattgtggcatcctaaggagggattctggagtgcctttcacgtgaagcatgccctgagacgtactcgaggcagtactttaatcgctcatgtgccgctagatgagggagcgccaatttgtacatcctagctctggccatagagttagcccacccttgtgtctccctttggcctctgcggtgccaatttccggtggtttcccttttccgcccgtttatccaatagcatgtaagagaggtttcctagatttggcaactttgagggaacgttccgcgtagctggtgacctaagacccgcccatcaccaccggacagattctgaacttgtcctgtggtgtttggtgtggttttggggtacgcaggagtacgttggaatgctttggagccgagagggatgggcccgcttgtgcgcttatgtgttacacggtgccaataaccggcctggtgcggctgccccgtgacccgtgggccttaccttcctggccatcgggggaccctggtgctagggtcccttgtgttgctttctgccataggggggaaagcatcgccttcagaattggctgctccgttggaacatttgaggcctactgtatccgtgtcctgacaacattccccgcaaacacgacatgggttaatttaaacatgttttgtttgcttgggaatgctcttagggcccggaagcttgtcattggattcatcgtttcctgaactacaggcgtagggcctattgtagcaggcatgtcttcattcctgcgtaccgaatggcatgaaggcacagcctgttaccattggcaccttttttccatgtaaacctccgtgatcccgggtcctttggagactcaagtgtgaatttgttttggtgttcggcgccagggcatcttgacgttggaatgtcaactcaacttgggcacctcgataaccggctcgtggctcgtacagacgattgtttggctctgtaacttgccagggacggctgacgatgtgtttagtctgccacttgcatccggcgctttggttacacgggagactaatggggggtgtggtatggcacaggctgggggtgagtctggggatgtccctgggcgttgctgcagcccattcgccctctggggatgagatgttcaggggtggccggtaccctacgctgccgatttacataatataaattgtaaatgctgcagtagtagggatctggacgcgcgacctgctactcttcggaaacgccaacccaggagcgtcgcctctggccccatactcccgccatgcgactgctcgccccctcccaggcctccctggtgagcccttgccgctccccgcattcctgctttcggcgcccctgcggaccccgatgacagcaggccttcccttcccccgttaatgaaaagaatgacagagaggttgtgacagaaggacagctttattcagtttacagagtgccctcggaggctacgatattcccgttaaatgtcttgttgattctctcaaaggtggggagggaggagctctccacaacaatgttccctggcagcgtgagcgcgcagccctgccgttggatgtatcttctcatgatggtgctgatagaggggtctccggcgtagatgaaaaaggcctgggccatgctctggccggtcacgatcgttatggggttgttggaaatgttccggaccgtcagcttgagggtctggcccggcttccactcctgtgggtagacgtagaagaccgggttggaggagtgggacacgacaacggccgtaatcttggagctcaggggggcctcgtaggtgttgttgtattccagctccgtgatgaaattaggaggaataatcacaggggagccaaagtagcggatgtctgtggattccccgtcccagcgccagtggctcttagggtaggggttgtaatggaaggcaataatcacatcatccaatagggtcatgcccaccttgacgttcagcgggccctctcgtttcaggtccggcgtgtccacggagactcggacgtagcccttaccgcggcgtatggcgttgaccggacacaccttccccgggaatgtgtgaatacgggcgtatgactttagaaatgggggcgtgtgctgcgccagcaggtaaggcaggcactcgtcctggctggtgacgggagagccactgaggaagatctggggctcgctggtgtttagcttgtccccactctgggtgcaggagcgtgtcagctgaatgtcgctctgcccgggcagaatctgcaggtagaggtaggggttcttgaccaatctgatgggcacaatgtaccaggtaaacttccctttctctatgaacaggctgcgcggattcaggacgcttagcacgatgtcctggtcagagtgcataacgaagaagggcttgaggaatacctcgttgtcttccgctccaaagaacaagaacgcaaccgtaaagtagcggctgccgtaggtggtcgtgttgaaggagaaagaaggtaacttgaagctgagtatctggcccaccgaggggcagggaggcagctcttggcactgcgcgtccagctgcaatacctgcttgttggtgacgcgaacgtatgaggggaagatctcgtacttccacacgcctctcatgaacgacgtgtctggtttttcagtgggccgcaggcggcggaggctgttcctgaacgacgagcgccgggacgctagtgctgcatgggctcctccggggtaagcttcggccatggccggagctcgtcgacgggcaaggtgagagttggggggcgggcgacggtgcggccccaatacaactctccgctcgttagctggtagaatatccgcccggcgtctaggttgtcacttcgctcggccggccagaagagcgcaagtccaagtctggtgctggggccgatgtgcagcggtttgtgcccgcagttgtagactgtcatttttatgggcgagtgggcggtccacacgcgcgggcgcagcacccattggtcgcacgccgcctcctggaatgtaaacccccagagagagggcgtgccgccctggagatggccctgtgccatcacatgtatttcctccttgggtggaacgacggcgtcgtgctccgggtggagggggaatagcgtccaggcatctttcagggtcacgagaccggggtccatgcttagaaaacagccctcccgggcggtgggcggcccgggctccagcagaacgtcgcagacccagccctcctcggccctgtccacctgtatgtccaggtgcacggacccggaggctgcgtctcgtgacatggccaggcctggtgccagccgaccacgtcccgtgtcccagccgaggccacgccagagcagagcccgggactgactcagggccacatcccctcggcccgcggacgccgcctcgccagcccccgggccttcatgggcccgctttctacctctctccggcaccccagcctggtcagccgcagaggaagcatgaccttggggtgggacggggcaggcgtgatcctgggcgcaatctttgccgatccccacaccttcactccttgttaggttgatagaatgtcggtaccacgccacggggggcgggcccgcatagggaaaagccagggagagcgatgtgggcgaggatgggctcaggcggccccagacacgcaatttgcccccctgggcggccgcagcctgcccctcggcggcccgtgccccagctccgtcacggggggcgcataggaggggtatatctaggatagccgcacctacacaaatgagacacagacacaggtcatgaggatttaggcaacgcaggcttgtctttatagttacaaacatgggagcgtgcacctggaagatgcagctggggtagatctttacatctttacagggcgcagcagccgccagacactgaagggcagagttcacggcgggcacctcccagagggagcccaccagcccgtacctggccacggccagggcctcgtaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttggggggtctttgccctcaaggtgaggctccttctaggaatgccgagccccctgcactagcttcgctccgctggggatctttgccagccttcatactagattcagcgatcccccggttgggaatcttcgccagcccccccgtcctgctatcctgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcctcggcaaagcgcagggtctcgctctctgaaaacccccggcactcgataaacagcgagtccgtgtccccgtagatgactcgaagctggccctcggggttgaggggcgcccaggcgtctggggacggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccaaacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatctgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccgcatggcaccacatacccctgtttatccgatggaatgacggcgcatttctcgtgcgtgtacaccgtctcaagtatgtcgtagacatggaagtctagagggcttccgtgggtgtctgcctccggccttgccgtgccctcttgggcacgctggcgccaccacatgccctttccatcctcgtcaccccccaccaccgtcagggagtcttggtagaaacacagggggggctgaggccctcgcacatccaccacccctgcggcgcctggggtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccaccaccaggaccagaatgagcatgccgccgaaggggtttttgaagaaggagatgaaacccgagaccaggctgctaaacaaaccccccaccgtgctgactaggttggtgatggactgacccacgctacccagactgtccataagttcccccaggccgtccacaaattgatttctgccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtaaggaagatctcgttgtcggtgcccagctgtccctcgtaggtcttggtgtcgttgataaagctgaaggacaccagggggcgcgagtagcacatggtctcggagccggggaccctcatgctcttgcgcagggtgacggtggcctggttaacgggcacgcactgggagactgagatgacatcccccaggcgcttggccgccaccgccttaccgtagatgctggacatgacggtggtgggattaatcttggttagttctctcagcaccatgttctgcctcttctgctccaggcaccaggcccgcgcaaggtctcccagcatgcggttgatctggcggcgcagggagtcgtaggcaaattggatctggacggtggcgggattgttgagggtgcccagggacttcccgggggccgcggggggcaccggtgtggtggcattccccgcattccgcctccggcgcctcagaacggcggcggaggtgctcccgcgggccgcgggtggggcggggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttttcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagcgtgtaagtgcccttgtccaggaaggctcggcgttcgccttgcgggttcgtccctcggttgtcgtagtccactatcttgtagttagttctcacgtggaaggagtctgcccgctcatggaaggtttccgtatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatctttaccgcgttgtagcactggtagatggtatccatctggtcagtttcgtagctctcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggcgcgggctgctctggggtctgcgcaccgaggcggcacgccagggcggctagcagcacgaccacgcttagcaccctacgccgagtcatctctcatttggaggtgcaggtagagaagggcatatagatccttaaatacccaccccctgcccttatacagaagaattaggggccggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaacgccttctggtgaggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtagagctcgttcctcttttgcaggatggcccggtactgggggtgcgccgtgaaggcggcggcgcagtccgccttcagcgcctccaccgcgtcgcccgaggagctgtagaccccgccgcagaagagccgctctgtggccccgggagccacggcatcaaacaggtgagtcagccttgcccccgccagcgcctcctcgcaggcccgccgcaccagggccaggcgacgctcccgggcaaacagggcagagaggcgggaatgtccgccaccctccccctgccccgttgcaccgatagcatggccgccagagttccaatagaggagctccgagagttccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagcccagcctgccggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtgcggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactcctggggtccagccgggcgcacacgctcagctcaaccgccagggcgtacacctggctgtacgccgccgccagcagccccgacatcgccgccccaggggtctctagacctcgagtccggggagaacggtggccagacggcgcttgcgcctgcccccggagccctgccctcctccacccagcagcagcccggccgaggcctgcgacgcggtgccgaccggctcggccacgctgataaagttgtcctgggctgccccgggcccaccccacactccctccagaaagtcccgagcggcccccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcgttctcccccgtgaagaccaccctgttcttgatcttgatgttcctggggcacagcatcagcaccttggacatgcgcaccggcagccgccggccgtacacccggccctgcagggccgcgtcgaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacaactgggtgaagacggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccctcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatggggctggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccaccgcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtaaaggacggaattggtggcaaagatctgcgtggacacgtggggggccaggctggcattatatcggtgtaacgcagccatacgggcctctgggccctcacagtcggcaaacaggggccaagagtcgtagttgaggcttgccggggtctcgtgcgaggcctccagcatggcgggcgcgtaactcaccgccagctcgcaggccgcgctgtccacaatcattaaggctcccgagtccgggtgactgatggttgaggctgggaactccttgaggggggccaccttggccaccttggcctggtcctgcaggctctgcttctccagcagctctaccagcttgcccacccgccggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttctctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctctgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcttcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgcgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtctcgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatggggacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatatgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggcagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcccggtagttgtgttgtgcagaggtctgatgtgtgtaggaggggtgggttcaacgcaggggcgttggtggcggagtctggcaacgcccgggtccttgctacctgtgtggtgtgtgaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagtacccaaaagcagcgtaggaaggtgtggatcaccgccgccaccgtctgtcatcgaaggcgggtcccggtcacctcctttgttttcaacctcttccgtcaaatttggagggcctccatcatttccagcagagtcgctagggttatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggccccactcacgagcaggtggtgtctgccctcgttggagttagagtcagattcatggctagaatcgtcggtagcttgttgagggtgcgggagggagtcatcgtggtggtgttcatcagtgtgtcgtggtccatgataatacatccagattaaaatggccataaacaggaggagccaaaggagatcaaccaatagagtccaccagttttgttgtagatagagagcaataataagcaggatgatggctaggaagaaggctaggatgaaggccaaaagctgccagatggtggcaccaagccgccagagaatctccaagaagtagatccagagacctaagactgcgttgaaaaaaagagtgttagggctggaaaggtgagggtgtggtaaataagtcctagggaatgttagatcttaccaagtaagcagccaaagatgaacagcacaattccaaggtacaatgcctgtccgtgcaaattccagagagcgatgagtaggagggtgactggggaaagaggagaaagtgcgttagagaaggaagcgtaagggaaagggggtggggggcaaagggtgtaatacttactcatcagtaggagtagaccaaggcctccaagtggacagagaaggtctcttctgaagataaagatgatgagaatgataataataagcatgagagcaaaggaatagaggacaaggagcgctcctccagtccagttactcataacgatatacagccagaacagtagcgccaagagcaggagaaggagagcaaggcctatggaagaggagagggggggtcctagagggggccgtggcgggcccggtgggcccctctcaaggtcgcgttccatggtcagggtagtgtggcaggagcaaggcaactgaggaaagaagctgacagagcagtgacagaggcttatgtaggccgcctacgagagagcaacgcgtgtttctggggatggaggcccggggggatttgcggggtctgccggaggcagtacgggcgccgctttcccgaaagcggcgtagtgtgtgtgcatgtaagcgttaaaagaggaagtagaaagcgtgtgtttgtgttagaaaagcgagtccccgaggggcaagctgtgggaatgcggtggtaaagcgtagcaggaaatggaaaggcagtgcggcaatcacaagggggagtgagcagtgttgtgggaagcggcagtgtaatccacacaaagaggcgtagggcgcgcaacgttgggaggtcgttgtcggcaggcgggaggctgtgctttaggggggttcaggtgaggcaaggctgtggggtaaccgtaggggaggcgggtgaggcggctaagagggctaagggtcggcgggtgacgaagcagcagacgggggatatgggaatttcagaatgaggtggcggattccggcgaaaagggtgtgggctgtgcaagtgtcatgaggcaggcgcggaaagtcgctgcggcttgctggcgtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatgg

SEQ ID NO: 4 - DNA, 173774 bp, Artificial
  EBV strain M81 delBNRF1
agaattcgtcttgctctattcaccctaacttttcttcttgcccgttctctttcttagtatgaatccagtatgcctgcctgtaattgttgcgccctacctgttttggctggcggctattgccgcctcgtgtttcacggcctcagttagtaccgttgtcagcgccaccggcttggccctctcacttctactcttggcagcagtggccaactcatctgccgctgcacaaaggaaactgctgacaccggttacagttcttactgcggttgtcacttgtgagtacacacgcaccatttacaatgcataatgttcgtgagattgatctgtctctaacagttcacttcctctgcttttctcctcagtctttgcaatttgcctaacatggaggattgaagacccaccttttaattctattctgtttgcattgctggccgcagctggcggactacaaggcatttacggttagtgtgcctctgttctggaatgcaggtttgacttcatatgtatggcttggcatgacgtcaactttacttttatttcagttctggtgatgcttgtgctcctgatactagcatacagaaggagatggcgccgtttgactgtttgtggcggcatgatgtttttggcatgtctagttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaaggttcttctggcacgactgttcctatatgctctagcactcttgttgctagcctccgcgctaaccgccggtggcagtattttgcaaacaaacttcaagagtttaagtagcactgaatttatacctcgtgagtatctatttgttactcctgtttagttgaagaaaacaagctattggattgtaacacacattttacgctttgttccttagatttgttctgcatgttattactgattgtcgctggcatactctttattcttgctatcctgaccgaatggggaagtggaaatagaacatacggtcccgtttttatgtccctcggcggcctgctcaccatggtagccggcgctgtgtggctgacggtgatgactaacacgcttttgtctgcctggattcttacagcaggattcctgattttcctcattggtaagtgtgacaccaacaggtgttgccttgttatgtcactgttctgacacatgacttacatgggtttggcttttgtaggctttgccctctttggggtcattagacgctgccgttactgctgctactactgccttacactggaaagtgaggagcgcccaccgaccccatatcgcaacactgtataaaggtaagtattattaaattttagagacactatcacgtgtaacttgacgtgcaaggatggaggagaggggcagggaaacgcaaatgccggttgcccggtatgggggcccgtttattatggtaaggctcttcgggcaagatggagaggcaaacatacaggagcaaaggctatatgagctactctctgacccacgctctgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgaaacagctatgaccatgattacgccaagcttcaaaagcgctctgaagttcctatactttctagagaataggaacttcggaataggaacttcaagatcccccacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccagcttcaaaagcgctctgaagttcctatactttctagagaataggaacttcggaataggaacttcaagatccccgggtaccgagctcgaattcactggccgtcgttttacaacgtcgtgactgggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctactgggaacctggtcctcctttgccagcgagcagtacgagtgcctgcgaccagatcggattaaccggtccatgcacgtgtccgactacggctataacgaagcactggcagtctccccgttgacaggaaagaatctcagcccacgccggctggtgacagagcctgacccacgatgtcaggtggccgtgctctgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgttcccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatattttgcagaatgcccaccagatcgcctgccacttccacagcaatggcacggacgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtcccccgagccccgggcccagccctcctcagaaaactctgcatggagaagctggacgtgaacctcccccccccagacctgtgtgctgtatttacaaacactacaataaaccctatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcaccacagaagtgtaagcaaagtgaagggctcggaaggcaggcggggcctagcaatgtcacagctaaatgcccaccggggcacacactcaagcggggtctcggagctcccaggtcagaccacgaaaggtcagcctgcaaggtggatggcgtgttttctgaggttatccccgctacgtgcagtgctgggtgagagagaccctggaatgtgtcgaaatgaccaagcgtccccgcagcggggctcccaacacgggttcccagagagggtaaaagagggggccataaagcccagggtgtaaaacaccgatcgcgccaccagatggcacacgtgggggaaatgagggttagcataggcaacccccgcctacacaccaactatagcaaaccccgccccgtcacggtgacgtggtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaactttagttttaggatttatgcatccattatcccgcagttccacctaaacggggcttaacgttacatcccagaagatgcacgcttaaccccgcctacaaccgtgacgtagctgtttaccagcatgtatagagttacggttcgctacatcaaacaggacagccgttgccctagtggtttcggacacaccgccaacgcgctgtgcggtgctgccgtcccgaggtcaagtcccgggggaggagaagagcggcttcccgcctagagcatttgcaagtcaggattctctaatccctctgggagaagggtattcggcttgtccgctgtttttgtgcctagttttgcacccacaacatgtaagggcccgctacccctacaacacaaaacaatctcctctaaccaaccttttcccaatcaattctgtgacagagtttcctggacacccagtcttagttcagatagacacccagttatgcagtgccaccaattccaatcatttttaaacctcctggaattctatcatcaaacggcatgcaggaaaaggacaagcagcgaaaattcactccccccttgggaggtggcggcatatgcaaaggatagcactcccactctactactgggtatcatatgctgactgtatatgcatgaggatagcatatgctacccaaatctatatctgggtagcatatgctatcctaatctatatctgggtagcatatgctatcctaatctatatctgggtagcatatgctacccaaatctatatctgggtagcatatgctacccaaatctatatctgggtagcatatactacccaaatctatatctgggtagcatatgctacccaaatctatatctgggtagcatatgctatcctaatctatatctgggtagcatatgctacccaaatctatatctgggtagcatatgctatcctaatctatatctgggtagcatatgctacccaaatctatatctgggtagcatatgctatcctaatctatatctgggtagcatatgctacccaaatctatatctgggtagcatatactacccaaatctatatctgggtagcatatgctacccaaatctatatctgggtagcatatgctatccatcgcaacattagcccaccgtgctctcagcgacctcgtgaatatgaggaccaacaaccctgtgcttggcgctcaggcgcaagtgtgtgtaacttgtcctccagatcgcagcaatcgcgcccctatcttggcccgcccacctacttatgcaggtattccccggggtgccattagtggttttgtgggcaagtggtttgaccgcagtggttagcgaggttacaatcagccaagttattacacccttagtttacagtccaaaaccgcagggcggcgtgtgggggctgacgcgtgcccccactccacaatttcaaaaaaaagagtggccacttgtctttgtttatgggccccattggcggggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccttagcaataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgttcaaattttattctgggggcgtcacctgaaaccttgttttcgagcacctcacatacaccttactgttcacaactcagcagttattctattagctaaacgaaggagaatgaagaagcaggcgaagattcatgagagttcactgcccgctccttgatcttcagccactgcccttgtgactaaaatggttcactaccctcgtggaatcctgaccccatgtaaataaaaccgtgacagctcatggggtgggagatatcgctgttccttaggaccattttactaaccctaattcgatagcatatgcttcccgttgggtaacatgtgctattgaattagggttagtctggatagtatatgctactacccgggaagcatatgctacccgtttagggttaaaaagggggccttataaacactcttgctaacgccctcttgagggtccgcttatcggtagctacacaggcccctctgattgacgttggtgtagcctcccatagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtcccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcactcccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtaaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcttcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaaaatgcgaaactacaggcccgggcccaggccttgcagggcagacggttaggctgacaagtggacaagtgtggcaggtgggcgggaaggggcacaagaatgccggcgaaactggaccacggtccaccccgccctcaagcgtccgggagccgggcggctcggccaaggagggcggccttgcgaacaatcattagtagctaccaacaagggcccccagatgcccccaccagtcaccccgtccgtgtccactcacatattccactcttatttttaaattcatgtgtcccaattagaaacccaagcgcagaaattagttgagaggctagtgttttaaacatgcactctaggccagccagagataatttcacaagactatcaagttggtgtaaacacgccgtgggaaaaaatttatggttcagtgcgtcgagtgctatctttggaacagtagaaaattgaaccttgttggcgggagaaggcataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttcttctgcaaattttagatcagatggcatagagacaaggacaccgaagacccccagagccctcatcgcagggttcttaccatgtggccatgtaggcccacttaacactacaagacctacgcctccccattcatcatgtaacccgcaaatcatctaaaccgtaagtctaagggcctcctgaggttttctcaggaggccctaatgtataattaatcatgcatttgatttaaaaaaagtaggttatactcattttaggccagtctttatttgcagattaataatttatgtgattctccttccctctaggactgaagaaacagcctcctgcacgtgagcatgtatctgaaataattattatgtcataagtgtaatgatgagaaagtcataaacccacttccctttacatgaatctgggcactgaattttggggtacctctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatataattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccagcggcccttctctctgtccccctgctcctctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacgttggacaggccctctgtccacccgggccatccccgcccccctgtgtccaccccagtcccgtccaggggggactttatgtgaccattgggcctggctccccatagactcccatgtaagcctgcctcgagtaggtgcctccagagccccttttgcccccctggcggcccagcccgacccccgggcgcccccaaacgttgtccagatgtccaggggtccccgagggcgaggcccagccccctccctcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttatccccagcccctcctctataagttctaggcaaacctccaatcaccagccaccttccaatgtagtctcttagagagtggctgctacgcatgagagccagctttgagccacccacagtaaccacccagcgccaatctgtctacatagaagaagaggaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaagggcagccaagggacacgtgttatcccaggctgcccaccctgaggatttccccccaaaatcctcctaccctctctttatgccatgtgtgttgttggcgtgtgttagtgctatgtaatgcggtgccgccaggtggcagcctgtttatagatgtgcagtaccccttaatgttaggtctgctttagggctgccaggtggcgcaatctaggattaatccacctgtatccctttccctccacccgcagtaacccagcactggcgtgtgacgtggtgtaaagttttgcctgaacctgtggttgggcaggtacatgccaccaaccttctaagcacccgcgcttgtgttttgctttatctgccgccatcatgcctacattctatcttgcgttacatgggggacaaacatatcatctaattgttgacacggatagtcgtggaaacccgtcactctcagtaattccctcgaatccctaccaggaacaactgtcagacactccattaattccactaacaatctttgttggggaaaacacgggggtgcccccaccacccccaccacccccaccacccccaccacccccaccacctccaccaccttcaccaccttcaccaccttcaccacctccaccacctccaccacctccaccacctccaccacctccaccacctcagcgcagggatgcctggacacaagagccatcacctcttgatagggatccgctaggatatgatgtcgggcatggacctctagcatctgctatgcgaatgctttggatggctaattatattgtaagacaatcacggggtgaccggggccttatgttgccacaaggcccacaaacagccccccaggccgtgttggtacagccacatgtcccccctctacgcccgacagcacccaccattttgtcacctctgtcacgaccgaggcttacccctccacaaccactcacgatgccaccaaggcctactcctcctacccctctgccacctgcaacactacttacggtgccaccaaggcctacccgtcctaccactctgccacccacaccactactcacggtactacaaaggcctaccgaacttcaacccacaccatcaccacaaagcatgcatctccctgtcttgcatgtgccagaccaatcaatgcaccctcttactcatcaaagcaccccaaatgatccagatagtccagaaccacggtccccaaatgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccatggagaccagagccaaacacctccagtcctagcatgcctgaactaagtccagtcctcggtcttcatcagggacaaggggctggggactcaccaactcctggcccatccaatgccgcccccgtttgtagaaattcacacacagcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctctgatgaagattatgtggggggacccagtaaaagacctcgcccctccacccagtaaaaaaccttgccctctccagcaaccaatgtatcccaaataaatgttacttcttttgctcttgaccattgacacgcctgtcattctatcaattaaacaagggaaaaaggtttagctattccaccaacacgaccccaaggaaggcttgccaaaattggggccttgctctcagcactttgccagcaacttatagcatggtaggcagctcaactcggcccgtcttactgcccagcctactctccactcccagtccatgttcgcactcctatgcatttccttccctcccacttttaccccagtcccaacccaaaaccacacacaacacatagaattgttagtttaaacagtttattgatacatggctgcttttagcctaattgtgtattgctctcgttgccaaaacctggtgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtccaggggcagccggggttcctggcgctccgggggcagccgggcggtcgccggtgggtccactgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgcgggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgccgatccctcccccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtcgccgccgggtccgctggtccggtgcacctggaaggcagggggggggggggcgtaagggaggggcgtggtcctgggaccccgcgccgactggcagggggtccccgtggcacagggctaggggtccggggggcagccgcggcccagcgcaccccgttcacgggggaggaccgcggccgagccaccatgggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccagctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggtcattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggccccccgcgtgccttcctgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccgggggcggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcccccctcagtgttcgccagcttatttccccagtccccacgtactggggcctgtggacacctgagggagcggccgttggtgggcatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcaccagaggacactgtagttctgcgttatcatgtgttgcttgaggagataattgaacgaaattcagagacatttacagaaacttggaacagatttataacacacaccgaacatttggacctggattttaactcagtatttttagagatatttcaccgtggagacccaagccttgggcgcgcgttggcctggatggcctggtgcatgcatgcctgtaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcagggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggttatacgcctgtggtgttctaacgggaagtgtgtaagcacacacataatttgcaagcggtgcttcacgctcttcgttaaaataacacaaggacaagatactaaagaaataactgaggtgagtgtgggaagatgggactacgatgtgttatgttaacgggtgagagcctatactgcagcccagactcggggggaggaggaaatggtaagagttatactctacttatcttttttgacactacagttaactgttatgtaacaatgtttgcttattttcatgttcaataaacgctatgttaatgatgaagaacctgtgttgttctttggaagtgggcccgatggggtagtaggttttgggagggtgccgtgctagatatttcaactgccacagaccccattttgtcccacctgttaccacattctaggtcctgcatccagtgggccaggtgtctccccatggctctttctaggtggatcccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagtttcaagagttaaaagcaactactgtttattttccaaaatgagctgggtatagttgatgatctgtaggcgcagctcatccccacattccaggtccttgatggcctcgtagatggcatcttcgtcgacattgacagtcttctcatataccgtgtctctggggctgacctttatgcagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgagcgggccacactgccaaccctttccattcttcccagctctgagcgagattttccacacctggacaccgacttcacgctatgtgccgaggcttttgaggccgtatagtttctgtggtgcggatgcattaggcggcgcaatgtgggatctgccggccgctgtcggcgtgcatccacggcctctggggtgaccggggccatcggttttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaccggctgcaagcgctgccttaaaggcctggaagctgggtgggtaaatctgaccaaacagcacgctcggattcgtgatgctgtggttgatggcacacagggggtcgcagaacaggtgcttgtggaagtcttgcggggtgcacatctgcagccaggcccttagcctggggcatggcacatccagcagcgtgttttgggtcttgatgaggaacacgatcctgtctaggattttgatgttgttgccgaatgagtccagaattaggctcttgaagcggtcaagggtgtccttggcgtccgggtgggccccgaggctctcgcagagtgggcagatggtccgtgaggcattcttgtgccttagtccaaacatgggggccaggaggcaagggccctgcgaatggtcgccagcctccggtctggtgatggccagggccaactccgccagctcatcgccgctgtattccgcgtttaaaccgatagcatggtggcctggccccccgagcaggtccgtcccctgccacgtacctaatagtagtccacagtagtcggccttggttgtaatttcaggagagagtcctcccttttcggccctgagaaatggatgctgaactcggtttctggtaggcaggtggcagcacagggcggtgtactggcccctgccgacgtcccctgggacatcctgggaatctttgcaggttctgggtccagggagggtaagaaaagtgggggtggttctgggccacatggacttgaagcagaagttggccggggactggccagtgaggatggatttcagaaactccaatttgtagtagccgaggttggcatttctaatcatgtcagaagaggacacggggaggaagcaccggcaaatgtaaaagtgaagctggatgtcaatggccagaatcctggagggcatgaagagggaatccaaccccccggccatggggaagtattttatcaggatgtgtaaaaagtccatgcccgtgatgaggctagagatccaggctcgtggggcatttagacagtagtagcagagcagggcatagtcctcaaagaaggccacgggggcatctgagtgattgaccagggtgtcgagcagatcacaaactcggcaggtgctggctggagagagggactcgtaggtgtggacgagtggtgggtaggctatgccttcttccgcgttggctggaagataggagtgggccatcaaaaggccgactgcctcgaactggcttttcagattgtccacggtccagggcacaaactcctccatctttggagttctgcccgcggtctgtgccacctctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaaggtgggctagcaagttctcgagtctatgaagactccgggggcagttttttgagtttctcgcctatgatccaccccaatctcgcccccataattgcgccatctgcctacgcgaggctgaacctcctgaatcactgcatctttctcgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcctgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctagcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccctgagacccgggagacggtggtggggggagcatggcgttattcttggcgcgccacaccttatctggcacgggtgctggcggtcacggccgtggccctgctcctgatgtttctgaggtggacctgacgttgccggcccttgaggagcgggagttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagcgttcaccggtggtgggtgtggagccgtggccttttgcaacgcctttttcctagcttattttttggttgtgcggtctgttttccccgcgttttccgatagaatagctgcctggatctgcgcccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagcgcccactgtcttttgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccctgggcctacaagtgtttcagatccctcgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcagccccgaatccgggcggtgctgccgcacaacgcggcctatgagctcgaccgtggctcccgcctcttggatgccatcatcccctgcttgggacccgaccgcacatgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaaggagttacctggtatttctgacgtcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccaagacaccgccccgcgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacaggactcggctagcctgactaagggtgaggctataacgcaggtcctgttccggagcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttcaaaaggcgcgggatagcgtgcgctaccggatggcgggtaatacatgctatccttacattttggcattttgggcagctgggaggcggcggatgggggtgcttctttttgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcccccaccgctttaattgtgggggtgggcagggcagctgcatcttggggcctctgtgcttgcgttttttgggggcttggtgccaatgcaccaactggggtgtgcgcgggggcggccaagccggaccccagggcgggtgcctgggggatgggaaggccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtgaataactgggcttctgtgaaggcaccaaccctggaatctggatggtatgtttcttctgtgaccccgaggcagtcgatggtgtagagtgtggagacaatgtgtaaacgatgggctttgaggggggctgttgtggtgctggttggggaaggagctccagggaatctttgggccatggccttggggaccttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgcctggggccaccttctctaagagagggctctgtgggctgggagggccagaggcctcagattcagccgtagtgctccccttttccccctggtctgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtttggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctccggctcgaaagactcggagtagccgtccaggtcctgcagaaaattcagcgagatggtctccaccagggaccggaagggctcggagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctgggaagctcttctccgcgtgtataggcctgcttcacaaagtcacgcaggtagtcctgaaacgcgaccgggccctccagcgggcgcaatgagtgccagagctgctgaagggcctcgggggcgaagcaccggcgtgcgaggagcagcatgcaggctcgggcgcgggccgtgctttggttgtggaccaggcccaagaactcggggtgcggccagagggcggcccgggtatccatctcctcccaggcgtcctggaagaagatgaagccggtgggtggaccggcgatgcggtggcgggtgaggcggcgcgcgtcttccccgtcgtcgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccattatctcccgttgttccaatagaataacttcccggtctgtggccggggctggataaggggggtgattcctagaggcgatgagactggcgtgcgctaaaagcgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagtgcatactgggagccagccgaggccccaagcgccaggcccctggcagcctccaccacgatcttgagctggcgcgggtcggtgtggcccctggcctgggtgaccaggtcctgcagcgttccctgcagctgggactcttcctgggcctcctggatgatggcctccagtcgggagaggcgccttttccagtctgcgaaggtctccttgccccccgcgacccgcttggggtccaacgtggccagagccaacctcagctcctccatgccatccatggaattctgggccatgccctcgacttccaggagccgtgttagctcatgaatttcaccgtcagccgcagcggctaggttcagccaggcacccacacccccagctaaggccagggctccttcggaaagaccccgcacggcctcgcagatgccccggatccacttggcggctgccagggatttccggtagggccacgagccgttcccggccgctgcccgggccagggcggcctcgaggggagcctggacaggggctttgggcggggaggggagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggtttcttaggccagagtgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgatcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggctgcttcctccgctcctcgccctcctcctccttctttggcggtagccgcgggggtggcgggccaagcgtccagtctggccagagggccggtctcgatctccgtgaaccagccgggttccgcagcctccattctctccgccgcaccaccatcgtccacgagcagggattgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcccgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgaccgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtacttcttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcaccgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctctcgtcgtccaggaccaaggggacgtccacgtgcgggcccctgtagatggaattatcctcgggttctcctcctccttctcccccctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgctcatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagcagatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggttcctctaggtcagacaggtagcggacgaggccagcacccccagatgcatcttccccaaaggagggctgctgcccgaagggaggtgatggggatatctccgttccagccctgtcagcggccgggggatggtttttttctggttcgagtgtcgtggctgatggtgggatctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggtgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgcccgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcagaggccggggccgcagaggccggggccgcagaggctggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagcttttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggggcgctggctttgcccccagtcgccgttactcatcttcggtggtgggacggggaggacgccttgtcgccccccttctggtccggggtcttacgcggctggcggcggcagccgccgagagataaggggggcacgtgtgtgcctccgcctctcctctgtctgggccgccgccgccgcttgcccgcctggaaggagagggggtagtccgcggactgcgtctgcgggggcaggaagtctcaaccttctgggctcgggccgcggtgtcgatatccgatggcctttccctctcttcctcgtatgctccttctcctcctcctcctcctcccggcacgcccctgagatctgcctcccctccctctccctcgtcctggtcggaaaagtctgaggaggaaaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcagcgagaaccgaggggcttctgggggtgactgtgatctgttccggatttaggtccatggcgggtgtgtatgttttaataggggtggtctctggcgcggcaggatgatggtcgaggacgtccaccagggccttgcagatgcgcttgcctagatacaggatgtcgtccatgctgaggggagggggggtgtctgctcccccctgcagaagccgcctgggtgcgggggtgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgaggtccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggagtatgaaacgctcttttccttcaccgctaccaccgcctcctcctcctcttccgtcgccagagggatctgcacccccccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccactgccgccgtccactgccttctcccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgccgctttcttcaccctctcccccgccggccccacccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggaggccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggcggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggaggatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactacggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgctggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccacgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtggccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttgggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcagcgtgaccgtcttgtcctgtaggtcccacttctttctgggaatcacaaacgatgccgaggtaggggttatgaccacgctggagggctgtgcaggtatggcgtgggccggagttggatcttcatcctcctcctctgaggatgaaatctctccatctgtggagtgttcttcgctgccgtccatagggtccatatcgcagtctgtgttggtgtctgagaccgcttcgagttccagaatgtggctctctgcagaggggagacaaaaggtggagactgccttgagcacctctatctcaggcaccggatgcccccggctccacggccccggcccctggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggtgtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggggcccttgatctttagatccaggtccaggaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggacgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccacgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagtgcggatctctcgcgagtcccgccgcagcttctcgtgtgcaaagtgggcaaaagcctctgtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgcttcttggcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggcgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatccaggatggcctccgcaatgtcagtgtttgaggccacaagggccttgatgacgacgggggtggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgccgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattgataaaacaagggatatgaaggtgtcattgacccgaggatccaaaccccctcccctgtctcccctcgagcgcctcgctcagcccactatcacccatggccaggcccggcacctcctcgaaggcgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtctgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagggggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggtgcggaaatcagttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccctaacgccacccgacgtgcccgctcccgctcccggggacgtgaagcaaagaaagtgcaaatttctgattaataaatctttattgactttatacataggtctcggcgtcatcatatggtggggtggtgtaggtatgggatgtcgacaagttacgcctgaaggcgcagtccgccatgaccagcagcagcagaagggtcagcacagccagagatgcccactgcagtactagcatggagaggtttgagaatctgggctgggacgttggcgggacaggcacggtggcttgggctgtggtaaccggtgggctcgtaaaagtccagcggggccgcagtttgctagaagtgctgggaggtagataggtggtcgcattgtatctcggtcttggcgtagttgaatcatcgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcatttttggggggcgtgcctttggtgacattaacctcccccggttttgtggatgtggaactgtttccagggcctgacgcttggctggtggtgcctgggcggggcgctggcgaactggtggacacatgatgtgtgctgatagaggctggtgtcacctgtgttatattttcaccacctgttgggtgagcggaggttagtaaaggcatatgtgacgttgtctctgggattgaactgggtctcagtgacatggaagaggttgaacttgaagttctgttatgttggcctgtggtaacatcactggttgcattttttggtgggctggtaactactggggtgggacttgttcctcctaaggtgtggttggtggcatttgcctgtggacttgtttctcccacagtagggctggtggcatttggggttggggtagtcactgctggggtggggctggtggcatttggggttggggtagtcactgctgaggtgggacttgtttttcccaaggtggggctggtggcatttggggttggggtagtcattgctggggtggggctggtgccatttggggttggggtagtcactgctgatgtggggctggtcatgtcgggggccttactttctgtgccgttgtcccgtggagatggacttggtgtcaccggtgatgcgcctgacgttgtgccggctggtgttgggctggtgacatccgctgtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgttttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttgtgtttttacgctgaaattcgagtcttgagctgacgttggcaaacttaagggtaacgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtacaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaacgtcctcatagagttatcagatagcagctcagaaaaggaagcagaagatgcccacctggagccagcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaggtgtgtgatgtgtgtttttacccatcacacaacaagaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcaacacttgggtgcacaggtggccgtaggtgtcacgtgaccttttccgccggcacctttaagccgccgcgatgtacccccggggatcgccagtggttgtatgttcagagctccgtgggtaacattgtacagagctgtaatccccgctacagtattttctttgactatatggctatacacaggagcctcacgaaaatctgggaggaaattttaacacctgaccagcgtgtttcatttatggaattcctaggatttttgcagagaacggatttgtcctatatcaagaactttgtcagcgatgccctgggcaccactagtatccaaacaccgtggatcgatgacaatcctagcacggagacggcacaggcttggaatgccggctttctccggggtcgtgcgtatgggctagacttgcttagaactgaaggggaacatgtcgaaggtgctaccggtgaaacgcgggaagaaagtgaggacgcggagagcgatggagatgatgaagatcttccttgtatagtgtccagaggtggacctaaggtcaaacgaccccctatatttataagacgtctgcacaggttgttgctgatgagagcgggcaaacgaacggaacagggcaaggaggtactggaaaaggcccgtgggagcacttatggcacacctaggccacctgttccgaaaccaagaccagaggtcccacaaagcgacgagacagctaccagtcacgggtcggcgcaagtcccagaacccccaaccatccacctagcagctcagggaatggcatacacattacatgaacaacacggcatggccccgtgtccggtagcccaggccccacctacgcccttgccccctgtatctccaggggaccaactcccaggtgtttctagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagtttgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccacccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacccgagcggtggatgttcccaggtgccgccctgagccagagtgttaggccaggggtagcgcagtcacaatattttgacctccccttaactcaacccattaaccatggggcacccgcagcccatttcctccatcagccgccaatggaggggccgtgggtacccgagcagtggatgttccaaggtgccccccctagccaaggcactgacgtggtccaacatcagctggatgctttggggtatgcactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtggaatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattaattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgtgggcaggccatgaatattgaggctcctagactgccagatgatcctataattgttgaggatgacgacgaaagtgaggaaattgaagctgaaagcgacgaggaagaagacaagagtggaatggaatctcttaaaaatataccgcaaacactgccgtacaatccaacagtatacggcaggcccgcggtgtttaaccgaaagtcagatgcaaaatcaaccaaaaaatgcagggccatagtaactgactttagtgtaatcaatgccattgaagaggaacacagaaagaagaaggcagccagaacagagcagccaagagccacgcctgaatcccaggcccccacagtggtcctccagcgaccacccacgcagcaagagcctggccccgccggcccactgagtgtccaggctcggctggagccatggcaacctttgcctgggccccaagtgacaacagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaacacgtctcaacttagcagttcggcaccaagctgcgcacaaactccatggccggtggttcagccaagtcagactccagatgacccaacgaaacagtcccggccaccggaaacagctgccccacgccagtggccaatgccactgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgaagataccaccgagagcgcccactcccatgtcaccacctgaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcgggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacggggggggctcgcactctcccgtcgttatcttggagaatgtcagccgggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctatacagtcacccgacaatgagcggggagatgatgtacagactaccggtgagcatgatcaggaccctgggccggggcctccatccagtggggcttctgagggattggtaccagaagagtcagactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatatatcgcaaggaatatcagggatgccgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacgtcttgtgcttcgtgatggcagccaggcagcgtcttcaggacattcgacgtggacccttggttgcggagggcggtgtgggttggcgacattggcttctgacatctcccagccaatcctggcccatgggatatcgtacagcaacactacgcacattaactcccgtgcctaacagggttggggctgacagcatcatgttaactgctacatttggatgccacaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaccatgtaatccagaacgcatttcgaaaggcacaactacagggtttatcaatgttagcaacgggaggtgaacccagaggtgatgctactagtgagacgagcagcgatgaggacaccggtagacagggttcggacgtggagctagagtcctcggacgatgagctgccatatatcgatcccaatatggagccggttcagcagaggcccgtcatgtttgtgagccgtgtgcctgcaaaaaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccaccctaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgcggggcctcctgccgcggggcctcctgccgcggggcctcctgccgcggggcctcctgccgcggggcctcctgccgcggggcctcctgccgcggggcctcctgccgcggggcctcgtataatggcgcctcccgtcgtacgtatgtttatgagggagcgacagctcccccagtccaccggccgtaaacctcagtgcttctgggaaatgcgggctggtggtgaaattacacaaatgcaacaagaaccaagttcacacctgcagtccgccactcagcctacaacgcctcgcccatcatgggccccatcagtctgtgccctctcggtgatggatgctggtaaggcccagcccatacaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccggccccccgggctccataccagggataccaggagccgccggcccccgggctccaatcatcttcatatccaggatatgcgggtccctggaccccaagatctcaacatccatgttataggcacccctgggcaccatggtctcaagatcccgtgcatgggcacacccagggtccatgggatccaagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccacctccccctatgccgttacaagatagcatggccgtggggtgcgactcatcaggtacagcatgcccaagcatgccctttgccagtgattacagtcaaggtgcatttaccccactggacattaatgccaccacgccaaaaaggcctcgagtagaagaaagttctcacggacccgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggctgtcttgttaaagttaaccggcggtggaggatccaccggccagacctctacatttggtttgggaacccaggtgatggccgcggctgccacccgccctcctcctcttaccctgggtggcaaaaagtatgccaggagtagaacaataacaagtgcgatggcggtaaacaatggcaccctcacctgcttaaacgaaaccatggcaaccacttcaaagagagccaacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagaagccacctgcggacaaaaatcaggcgtttagatggggcattttatgtttgggccattagccacctgggcattcgtgttactgtatactgacctcacggtagtgctgcagcagatgcttaaacttggcccggcattttctggaagccacccgattcttgtatcgctttatttctagttcagaatcgcattcctccagctgcgagcaagggaatgcgttactacaagtggtgcctagtcagttgaaacaggccccaccgtccgctgccgccctccttgagccccaccgtccgctgccgccctccttgatcccctccttaccgattctggctgtagtggtttccttgtacgtcgtgccggggcagccgctggtgcaggctgtggagcaccaatgtctgctagctgttgttcttggttagccccggggcaagccaacaccactgctgctgctggttgaacagtagaattgtctccaggttgaggtgcttctcccccggcttggttagtcagttgattctgggttatgtctgagactgggaacagctgaggtgctgcataagcttgataagcattctcaggagcaggctgaggggcaggaaaccacgacccagttggtgcggctgaaacatgataggcagtgagctggccttgtggcagaggctctggcagcaccggccacagcacacaaggcaaaggagcttgtgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctctgaggcacattagcaatgcctgtggctcatgcatagtttccaaaagaggaggaggcagttttcagaagtgtctaaaataagctggtgtcaaaaatagacagcccagttgaaatatgcatggcatgcagcagacattcatcatttagaaatgtatccaagatttcattaagttctggggtcaggggggagtccagattcaaatcctctgtcatggactctagtgttgtggtcagttcgtccaaatggccacgagggggcgggtggttcaggtccatctgtccacatatggctgcttcctccttctggggaataacagtgtcagccatctcccttagggccttcacggcctgactggtttcctcatcagggtcctccaacagatgacttgcctcgggggttactgcgggggccgggtcaagtggcttgggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttcctccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaatgccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacgcccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcatgaaatccctgacctcgatgactccgatgctgttttcgcacgcaccttattggcagccttatttcacctcaatatgttctttattctcaaagattacataacacaagactccatgagcttgaagcaggcccttagtggtcattggatgtctgccacgggcaaccccctgcctgcagcaccggagaccctgcgaaactacttggaagctttccgaaattcggataatcacttttatctcccaacgacagggcctttaaacaccttcaaatttcccgaagagcttctggggcgcgttgttgtgattgattcctctttgtgtgccgccagtcacgttcaggacgttatcacccgtggtggtggggcgggtgttcctcgtcctaggtttttggccctgcccccggccccatcccgtgagccccagcagacatgctctcagttaacgagcagagggaatgaaagctcacggcgaaacttgggccagcccggggggacctcccccgctgttcccccagtttgccccatcgtttccctggcagcctcccgggccaagcaaaaccgcgggggcacgggatccttgcacttagcccagcctgagggaacctcccccgccgtctccccagtatgccccatcgcttccccagcggcctccaggtccaagcagcaccgcggggtcactggatcctcacaggcctcacccagctcttcttccgttgccccagtagcatctctgtctggtgaccttgaagaggaagaggaggggtcccgagaatccccatccctaccgtccagcaaaaagggggccgaggaatttgaggcctggcttgaggctcaggatgcaaatcttgaggatgttcagcgagagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggacagaaggaagactcatctggaccagaaggctccggcggcagtggacctcaaagaagagggggggataaccatggacgaggacggggaagaggacgaggacgaggaggcggaagaccaggagctccgggcggctcaggatcagggccaagacatagagatggtgtccggagaccccaaaaacgtccaagttgcattggctgcaaaggggcccacggtggaacaggaacaggaggggcaggaggggcaggagccggaggggcaggaggggcaggagcaggaggggcaggaggggcaggagcaggaggggcaggaggggcaggagccggaggggcaggaggggcaggagccggaggggcaggaggggcaggagcaggaggggcaggaggggcaggagccggaggggcaggaggggcaggagccggaggggcaggaggggcaggagccggaggggcaggaggggcaggagccggaggggcaggaggggcaggagccggaggggctggaggggcaggagccggaggggcaggaggggcaggagccggaggggctggaggggctggaggggcaggagcaggaggggcaggagccggaggggctggaggggctggaggggcaggagcaggaggggcaggaggggcaggagcaggaggggcaggaggggcaggaggggcaggagcaggaggggcaggaggggcaggaggggcaggagcaggaggggcaggagcaggaggggcaggaggggcaggagcaggaggggcaggagcaggaggggcaggaggggcaggagcaggaggggcgggagcaggaggggcaggaggggcaggagcaggaggggcgggagcgggaggggcaggaggggcaggagcaggaggggcgggagcgggaggggcaggaggggcaggagcaggaggggcgggagcaggaggggcaggaggggcgggagcaggaggggcaggaggggcaggagcaggaggggcaggaggggcaggaggtggaggggcaggaggggcaggaggtggaggccggggtcgaggaggcagtggaggccggggtcgaggaggcagtggaggccggggtcgaggaggtagtggaggccgccggggtagaggacgtgaaagagccagggggaggagtcgtgaaagagccagggggagaggtcgtggacgtggtgaaaagaggcccaggagtcccagtagtcagtcatcatcatccgggtctccaccgcgcaggccccctccaggtagaaggccatttttccaccctgtaggggatgccgattattttgaatacctccaagaaggtggcccagatggtgagcctgacgtgcccccgggagcgatagagcagggccccacagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagttctcctggctaggagtcacgtagaaaggactaccgaggaaggaaattgggtcgccggtgtgttcgtatatggaggtagtaagacctccctttacaacctcaggcgaggaattgcccttgctgttccacaatgtcgtattacaccattgagtcgtctcccctttggaatggcccctggacccggcccacaacctggcccactaagggagtccattgtctgttatttcatggtctttttacaaactcatatatttgctgaggttttgaaggatgcgattaaggaccttgttatgacaaagcccgctcctacctgcaatatcaaggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccacctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagtctggcctccttaaattcacctaagaatgggagcaaccagctggtcatcagccgctgcgcaaacggactcaacgtggtctccttctttatctccatcctgaagcgaagcagctccgccctcacgagccatctccgtgagttgttaaccaccctggagtctctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccattattgcctgtgtccgacgcctgcggactcaggccaccgtctacccggaggaggacatgtgcatggcctgggcccgcttttgcgacccctctgatattaaggtggttattttgggccaggacccctatcacgggggtcaagcaaacggcctggcattcagcgtcgcatacggctttccagtcccccccagcctgaggaacatctacgcggagctgcaccggagtctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcataactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgatgaagacccatccgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttccgcaatccaccaaagacaaggttcccaatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggctttggctatggtcatggccagctttgagctaatgccatagtcacggatgctgcagaggttcagggacttgtcctctatagtctcatacagcttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgccgccgtaaatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacactgagctgtgcttcacgtaggtgacattgtaggtgaccttgacccgttcttcatcctgctcggttcccaccgggaccatgtcttggtcggcgaactgcgagtagttaccgaggcgtgcataattcttttggagccaggtgtgggccgtgaggcccggaagaccgaccagggtcttgtactgggccaggggatcgaggaagacctcgcactccaccgggcaggtaaacatggtcaccccgcccccatctcccccagttccccgcgcggcgcgcccctgcccggcagtcttgagcgtggcgtggagggtggtgaggaaggtcttgacctcggcgtgggagaggaagagccgggtccagcccacgtactgcgtggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtgcgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgagaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgtaggacgcggcgcttagccagggtccctatcctcctgactatacgcctcacggaggcgtctgaggtcatgtttaacatgaacgtggacgagagcgcctctggcgccctcggctcctcggccattcctgtgcaccccacaccggcctcggtccgactttttgagatcctgcagggaaagtacgcctacgtccagggacagaccatctacgccaacctccgtaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccattaggagtatcgggacggaattatatgaggcaacgagggaaataatagagtcgctcaactccacgttcatcccccagtttacggaggtgaccatcgagtaccttccgaggagcgacgagtacgtggcctactacggtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcgcagcgcaaggaccccaagaaggagctgctgaacctgctggtcaagctctcggagaacaagaccatcagcggggtcacggacgtggtggaggaattcataacggatgcctccaacaacctggtggaccgcaaccgtctatttggccagcccggggagacggctgcgcagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcagtacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcaagcgcgaccgggggagatcatggcatccggcaagcaccatcagcccggggggacgcggagcctgaccatgcaaaaagtaagcctgcgcgtgaccccccgcctggtgctggaagttaaccgccataacgccatctgcgtggccaccaacgtccctgagttctacaatgccaggggggaccttaacgtccgagacctccgggcccacgtcaaggcccggatgatctcgtcccagttttgcggctacatcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaacggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttttgacctcggggaagatggggtgcctggccaggtcacccaaggattactgcgcggatctaaacaaggaggaagatgccaactcgggcttcacatttaacctgttttatcaagattctttattgaccaagcatttccagtgccagactgtcctccagaccttgagacgcaagtgcctcgggagtgacacggtctcaaaaataattccctagaataaactgagaacagtcatcagtaaatctgtctctcgagtgatttccataggcatggcgtagccggggtggagggccgatatcacatcaagcagaaaggccataatctctcgaaagtaggcggtggggctgagaccatgctcagtggccgtctggcagggggccgggcgcgctccatccttgtccaggagacacacgtggcttccagagaggcgcagcccagccctccgcagccgctgaagccaggctcgcggaagagcccaaaacctgtttcggcgccgcccaggggccagtctccgggtcaggtcgcggaccagggtcaacaggtggtcgtgggatggcggggccttgtctgcctcgggtctcgccgctagttggtccagggtccaggagaaggcttcgtgccagaccaaaaagggccccgagtgctccctacatccacccacgtaaagatccccctgaaagatggccatcagtaggcacgcgggcccgcgtcgagccttcacccgaatgtgtctgcgggccacggtggcctctccgcccataacatcccggtcgagccggctggcatcctccgagtctttcacaccttgcaggaaagcctaggtgatacagcaacagaaagctattagctggtggttcccccaccatcattcttcctgttaacgggaagaataagagttgggcaaaccccgggggccgcgctctcccacccagccccgctcctcacctgtgctagtggctcctctgaaggatgggcggaggttgttgccacaaagcccaggatgaactcgtctgcataagcccaggtcagtcctaggtcagcggccgcgtggaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacaggggcgcccctggcagagaggtggcagcgggccaattcgtagagccaccaagtggcatcagcctcaaggatggctgtggcctccgcgcgcccaaccaccgtcgtctcgtcctccccccctccctcgccgccctcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcgagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccacctcggacccgaagccatcaccaggtgggggttgttggtcccgcccatcatcccccgagcagctttggcagaccacctgtgctggaaagagaggctggaagatgaggccctgctcatcctccacccgggcagcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtgacattataaaaggtaaccgagctgacccgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacatgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcatgcggcacaactttggcttctactgcggcatgttcatcgcctccatcatcctgatcctgcccttggtcaggtacgaggccgtctttgtctcagccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacaacagacagcgaggaggagatcttcccctaatgcaataaaaacttaaaacactgaggttactttcccgtcattctttcgggggaacgaggggaggcgggaattgggttaagataggggcgaagggtggggtgggtgcgagaattggggctggggagggagaggggagtggcctcggtgccgacgccggggtaccaagataatggattgagtaagcatggtgctctgatcgggtccgccgggttctcgggggtgtagtgggtgggcattgcatatttttgccgcggtgctgttgggccttggactcggggtgatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcgaccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaactctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggcaacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtcctggctgtcattctcttggactaacgaggagacaaagtcacagaagccagtttcaccagagaactcttgtatttgtttacagaggcaatagagatagacatagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctccccatgccccacatggtgtctgtgaaatccaccaggatgttgctggggctaatgtccgaatggaagaggccgcagtgccgattcaaaaagtaaacggcatctttgaggccctgaaagccccgcaccaggggctcaatactaccatcatgccagtggccataatcctggagactgcatctgaactgaggcataaacagggcgtggcaggacgtgcaggccgacaggtagtccaccagggccttgtcctgcccgtcctcggccgtggccttcccaatctgaatcatgtcacacaccatgagctcgtgatacagctccgtcacagagtcatagagtttgactgtggcattatctgcatgtgcatacacggccccgtagctcccccgccccagcagatactcgcaggtaatggggaggtgatcacagcgcgtcatgttctccggcagctttacatagagggtttccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgcggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagccgagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggcccctcttgccccgtgctgcagcgtaaacacagtgacgctcttcgcagtgggacctggggccgtagaagagggcccacatccaagggagtgggtcttcaggcaccagggaggtccaggtatgggagtgggccaatatttgcaaggcctgacctataacctcatctttgttccaggccagcgcaattcgcataaggtccccatcaaacacctcaaaacacagacccatgcccatttcaggctgagagggctccatccggctcgaccacccttgtccaccaaactgccattcttctggtaaacgggggttgaggggcaagagctccaaagccaggctcgagaagtcatagtcatcctcggccacacggccggagctccgggcctcgtgccagggcctgttgtcctgagggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacgggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccccgcccttcacaccccagtccaggtccagatgtgcctactaccagagctacgcgacacgttactgcgcctgctgcccccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcgggttggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacgcgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccaccgggggacctggagtcgatcaccttaccccaggccgaggccccttcctcatacagcgggtggctatctatccataggcaggcatccggcgtctttggtgcattggagatagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagggtgcccccgacccgacacccacagtgccgccagtccctgctcggcctccgccgccttccccaccggcgctgccccggatgttgctggggttctcgagggctgggtggtgcttgggcacagaggtctcagcagccgccttggtctcggccccggccctaagtctgagtcccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgatcagatgcccgtcggtcagagcgcttttggccccctcaaagagagacaggtaataaatctgtagctccccaaccagccctccttcatcgtaaaatcgaagggcggccacgtggaaggggttgtagagctctggaaggccctcctcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagggccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgactcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatctgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacgggacctacacctacaccggcaagcagcgcaacctctctgacgacgtgttggttgcgctagtcatggctcattttctcgcaacaacacagaagcacacgttcaagaaagttcattaaactttattgactacaccagtcccttgtaaagcgatgggtctcgcgtgacggcattcgtgagcagggcttcgtccaggggcttgttcttggtggacatcattagcccagctgcaaatatcagaattagcattagaaaagtgagtcccacaaacaccagtgtccagagaggaagaccgtaagataaagatggctgcctctcatctggaacggtgggaagctcagcagttgtttttgtggcattggacgtccctttggaggacagcgtgggggccaaggtggtagcgtttgtaatccgtgtagtagcactggcggtggtggaggacctggtggtgacattgctagtcacgcccgtggaggttcctgttccggactcggtggcagtgatgttctgtgcagtgaccttagtggtgacattgatggtggatgcgttggaagttgttgggactggtgtgacagttgtcccagtggatgtcaccgtggttgtgttggtgctcaggagagcagtcgtggttataggggcgctggtcgtggtcaaggtcgtagactggtttgtgctaggacccgatgccgatggtgatggtgtagtcacagccgttgtgcctgtcacgttccccgccgaggccgtcgaactgccactagatgtccagataaggcttgtctcacagatgagtatcatggccaggacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcgcggcccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcactcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgtgtccgggtggtctgattctgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatctcctggaagagattcaagaggtcgtgatgctcatgccggataaggcctcggaccaggcgcatacttgccctgggcagcagggtcaccatgatgcaaaagtagagactcagattgtccagcagggccaagccaaggggccccggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaacaccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagccccctgttgttgcgcagaagctcctccttgttgaaaaatgcccggcaggggctgtagaggcctgggacggccgtctggcgataggaggagttgtacatgatgtcgcccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagtgtcccattgcgctgagcgcccaccttggccttgatgtagtcgttgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctgacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaagcgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcatggaagagacactgggtgacagcccgggtcctctcggagaaggcaaaggccaccagcccgttcaccaaaacagtctgctctgtccgcttgtcggcgggattcggggccagctgctgcgtaacgtcattgtccaccgacacacgcacggcgcgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggtcgggaggaaaacgtagtaaaagatcttttccagcacatccgcatgcccctcatctacataagggcctaggtgcagacggaaatcgtggtcgtggtccccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagtgcgcagacatactgacccacgctctcatcccccacaacatctgacccggccaggcgcatcagggcctgctctagggctataagttccccatagatttttctatacatggaataggcctccttggagatggcgttatttcccaggtgacggcagatgaacttgatcatggaaaagctgttcacaaaggcaagcctccctgcccgttcccagtaggtgttgatgcacagggacaccaaaggcacgttcatgacaaacttttcctcaaacccgtggatcatagcctcaactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacggccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtatacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccatgatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcgtggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattctgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacagcccctcggccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacctgcacttcccgaggatgctacccttctaatcaaatggttggacacggccctgggcagggaggccaccttttacgcgtgtcgggctatgcgtcgtcttctactcggcgttatccgaataaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataagcacgagctcaatgtttcgccttatcatccgctacttgtctcatcaccaatttgagcgctgcttcgagcagttctgccgcgtggtcccgcgtcgcttcctagggacctgtaagcaaaactctgcaaagatgctggctcatctgaagcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggacactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcctgcgagcttccagttcccctcctccccaaccggcgccctattgcgatgcatagttgctgcggccctgctgccggaggtgtccgtggggcaccaggagctgtctccgctcaggtccagaagccagggaaggcagacggatgtcaggtcgggcccggacccggcacggaggctggtggccctcctgcgaagggaagatggggcacctaaggacccccctctgggaccgtttggacacccccgggggcccggcccggccaagagcgaagacgaggagtctgagcgtcgagacgcccctccacccccgctcgatttcagcttccaagcttcccggttggtgcccgtggggcctgggtttcgcctgctcgtgttcaacaccaatagggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccaggacggtctcaacgtgtcctggtttaaggccgcaactgccaccatatctcgagtgcacgggcggacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagcttgttgtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccaccgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagaacaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaagacaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctcccagtctgataccatcagtgaggctgaaaccaaggcctttgagaagctggtagagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaaccggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacgttgatgagcgggataatcatcagaactttgtcgagcctgtccacgcatttgtaggcggggagatgccacgcatccctgtcttctcgctccaaagagagacgcccaagaaacccatccacagcatttgaaacggccgcctggtccagcattgcctcctggggggccatgctcagcagcttgtctcgtgtgaggtcaaatcgtaggctgaggtagcacggtgagaagagcccgctctccgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtcgtcaggtgaccaagctcctccatcttgaccgtggccatcagcatggcggccaagcgctccagcccgtaggattgcatgcccttgaccgtggccccataacatatgccgatgatgtctttcaggacagtcagctcaaagaagctcttggccaaccagcggaggtccacgcagccattgccagtctcacccacggcatgacccaccttaaagaaggccacagaaacctcaaacatggtagtcagcgtttccgtgtccagttctggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagatcaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctaaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtagtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgtcaggtgggtcacaattggaacccgcgtgctctccttcctctgagccttggcctggcgggtgtcttgggcatcatccagattcagaacattcatcacactcccacttagccgcttcagctgggcagcatgcttggataacttactaaactcacgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccagccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgccggtggctgggctcccctgggtagggtaaaggggcacgatgtgtgccggctacccggagagtttccagtattagatgtcacggcagcctgggtccggcacggcaccctctccccagacagtccggtcggagccatcaaggggggccagtgggtgggcacctggtagagtccgtcatcatcttcctcacctgcccctgagtcactgccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccgaggtctgtgtgccctctccacgcacgacctggcaaaatttcacagtctccccccggctagaaaggcggcaggtaagcgagcgcaccttaggtgttactccaagctgctctctcttaagagctgggagcaactagcctcttttttgtctctgcccccgggacccacgtttacggactttagactatttttcgaagtcaccctgggtcggagaatcgcagattgcgttgtggtagctctgcagccttccccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctcggcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtaccggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgctgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcgatgcagcggcgcaagcctgccgtggcgtcagctggcatgccgggcgcctatccagtccagacgcttttccgccatggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcggccctcgcccacgcttgcggcgcgggagatcctggagcgtcaattctccgcctcggatgactacgaccggttgtacttcctgacgctgggctacctggcctcccctgtggccccaagctgagccagttcctcgcactggagtgggtcattggcaaagaggtaaataaagtcatcgcacgggggttttgcctccttctcgtctcttgtttcgggtaggggagtaaggccgtgccaggccgccatgctcagggccacggcgtgccagaggccctcgtagtcgtgcgcatccgagaggatggcacggtccagaagcagatagccggccaggcagaggaaggccacaaagagggggcgaaggcgggcccgaacccgggtttcatgctcatctgccccccagtgaacaaggcagtagaggacacccaccaccaggcggttagggaggacactgccaaggttgaagagcagatttccgtcagccagggtgacctggctcaggtccggcgccctgcgcagtccaagctgcgcccacacacatgcacagacggcccctgtgacatcaggccggtcatgcaaaaacagacaaagagaccgtgagcggttaccggggcgcagggcctctgccgggaagcccacccgtgccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgaacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccatgtgtctatctgtgccctgggtcgccggcgcggcaccacggcagtctacggtacagaccttgcgtgggtcctgaagcactttagtgacctggaaccgtctatcgccgcccagattgagaatgacgccaatgctgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcaaaccccgctaccctacgcggccccgctgccccccttttcccaccaggcaatagccaccgcgccttcctacggtcctggggccggagcggtctccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcgggggactattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccacccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccacccccgcggaaagaaactggtgcaggcctctgcatccggagtggctcagtctaaggagcccaccacccccaaggccaagtctgtgtcagcccacctcaagtccatcttttgcgaggaattgctgaataaacgcgtggcttgaaagtaaactttattgcgtgttagtaactgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagcgtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatacgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtggggggaaggagctgacacgagtgcgtagaaagggccaaaaatacaccagctataaggaattgctcaggccaaagttgttcctcaggtggctttaggcctaatgtaggcaattgcgtgcctagaacattgctaatgtgccctgtgtttcctgccttcatgcaaatatcctacctcccccggcctggtgcaaaatgtctgcctcagaatactaacagctaatccaagctaacattctatcagtaaacgggcagaaaacggataaggaccgcggagtttggccctccgcggtgtccggtggtcctcacacgtgccccccccgggccgatggctgaggcccggaatatgcaagtgcatctttctaaccagtaggggcctccacctaggtgctttgttaatctttagtgggaactagtgggagtgctgtgcctagggtacccctatcctagaggtcctaccggagctccttgtcttgataatccctgtaaacacacaccacctaagaacaaggcatcgttaacctttggtggaacctagtgttagtgttgtgctgtaaataagtgtccagcgcaccactagtcaccaggtgtcaccggaggctacttgcctcagtgccacttttaccttctcaaatctatacgggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctgtatagtcacgaccccaccgaaccaggcatgatgtagaataaaattttatgcatcgtcttctaatctgtgccgcttggagggaaacatgaccacctgaagtctgttaaccaggtcagtggttttgtttccttgatagagacacaaggactgccagccccgttggggagggggtggtgggtacgggagaatttgggctcgtttaaacaaagcctcctctgatgctctgtggcacctcaaggtgaatatagctgcccatcgacgtatcgctggaaaccggtgggccgctgttcacctaaagtgacgcaaggtctgtcagccgccagggtccgtttaccaggctttcaggtgtggaatttagatagagtgggtgtgtgctcttgtttaattacaccaagatcaccaccctctatccatatcccacaattgataaacctccgcatgtccaaccaccacgttgaacaggatgtggcaccctaagaggacgcaggcatacaaggttattacctagtccttgtatgcctggtgtccccttagtgggacgcaggcctaggtagcatcatttacactaaaagcagtgaccttgttggtactttaaggttggtccaatccataggcttttgtgaaaacccggggatcggactagccttagagtaactcaaggccaagcatttcacacctgcaaatgcaccatgtaaccacagatctaaactgaaagttgcagctttagatggcaaggaaacttgggtttcaggcatagaaagcctggctcactatagcagcccatgtttgttccagggtgggggaaaggcacatgcccttagaaaacttagctgcaaaaattctattgtgttgggagagcctccatatctaaaggcctttcctcacaatacaaatgttactaacgtctgccctctggagacctgctatgtggctagacgtatggcctacccaagacgttgggggtctcgggtaggccatgattcttccaggcataggttacaaccagtcactgctatcaagcctactcagttcccaacgcagcacataccccccgcctctcctgccatgaggacttatggcagtgtttactgttctgcttttactcttggaccaggctgtcattctatcagaataacaggggaagcaaggccccctgcgtcagcgggacacgtgtttctagaatctcggagccaataactacctgcccctctaatctgtatgctgcatgaaaaaccacatacacgtgatgtaagtttagccagtttattgttacaccaatgccccgaaagtctccccctgtcgctttgggtctcaggacccagccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccggggttccggccctggagctcggggggcggccgggtggcccaccgggtccgctgggtccgctgccccgctgcggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgccccgctccggcggggatgggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggtcattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccatgatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggccccccgcgtgccttcctgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaagctggattttggccagtcttcaattttggggagtggttttgtgtgagccggaagttggcaatggggtgagggcggcgctggttaagctgacgacctcccaaggtctctcaccctgggtacacaggtggggcggcagcctctaactttggctgtggcctctatttcctccctttcctagccagggccatgtgttcctgcatgtctacttgcctcctgtggtggcagagcttggccctgggcccaacccccgccttgggagcctgtaggggccaacacccttggtttgtttgtgttcctgtttgctggcaacttactggcagccgagcagattctaatgggcgcccgccttctttctctcttgttttattaatagaatctcagccaggacctatacctgagacttcaaagtctggtcctgggttctgagacccccaagatttgtcatgcacacctgcacacctgttggtattgggtttctattcttgagtgtgaaagtttgtaaaaaaattcataaaatgtcactaattcctcttacctgtttagggtattgtgcaattcttcagcctgcctattttcaatttgcctaaggtggcaatttaagatgtggttaattaaccattttcctgtctgacaccactgcatgggcaaccgggttccatggcacatttagagataaacatagatgtcttgtcttgctcatgtgcagaggagggggtgttggtgtgcaatatagtttctggattccaaattgagttgggggtgctattttcactatggaattaaattactgacattagacagtggacaccgggctatatgtggggatgtctgtggcttgtcatttcctcttagaaggtaatcccccatcttaacttccctttaaattgtgatgcaagccctgggttatttatagaatgattatctaggtttgatagtctgaaggctgggcagagaatgtttgtaatttttattcaccttctttaccccccacgagtatccagttctagaagatctcctgatatcccgggctgccattattcccttgagtgttatagcttcctcttaacttaagcaagagctccaggatgttagcttttttggtggggctggttgtcaggaagaggttccagtgttgtcctttatttttagatgttagctttgtgttgggttagtatgggctgggtattcactagtgaaggcaactaacacagttagacgtgctagttgtgcccactggtgtttatccggtcccaaatgtcaccacagaacacaggaggctggatttggcagcagcacttgtgcttttgttgatttttacccgtgtatcagagttgggggatgctagccaatttagcttcccctccccttaacagggggtctcgcggggtgccaattgtcgcctgccttcccctgcttccccttgttaacttatagcatgataggtaggtcacccaacgtggaagcctggtgggtgatccttcctcggtagggagcgcttagggctgttgagctcaagagccccacctgggtaaaatgtatgttctaaagagttacccaattataacaaaaatgttgtagggtaacgaagacctaatggaagtggtattgttgccgttgaaagacgggtgtcctggctcaagttcgcacttcctatacagtgttaaagccttgtatcggaagtttgggcttcgtcccagtgtactcgataatgtcgactgctgcgaaggtttgggccgtcttccagtaggtgttgggggtccccaatcatgaggttaggcaggtgcacttagctctttagggacccttaagccagacaatgtagtgcccctttttttgcaaattggccttattattaatttcttgttaacactaattctgttctatgaccccgtgtttttcagatgccattgggcgtgtcactgagctgaatttggacgcagctacttgacctttgcccccgtgcctccagcgctgataagtgctgcgtccactttgtgttacaggtgggccaaacctccagaatatcaattggtggggccttggtgggctgcataaggcagtaggtttgaggtgacctacttggaccatgtggatccagtgtcctgatcctggaccttgactatgaaacaattctaaaaaaatgcatcatagtccagtgtccagggacagtgcactcggaagtctcatcatctccgtttgtgtgtttagtgtggccagtacggccactcctgtgccacgccctggcatgctgctgacatctgggcgccaatttcagcgggcccttttcccccttgtttaccccatagcaagaagggtaggttacatgggtattttcccatcagcacctgactggccggtgtaattagaggagagggcaacaacgcaaggctgttgttttatttgggttacaagacctgcggcggtcaatgggtttactgattacggtttcctagattgtacagatgaactagaactgtcacaatctatggggtcgtagacagtgtgcttaccagacttccatggaagatgtgaatttgctgctagctatatgggtggcgctatgggctccctagggactcatgtagtggggctttgtgatagctaatgaatgtggcagctgttgtttgtactggaccctgaattggaaacagtaacttggattctgtaacacttcatgggtcccgtagtgacaactatgctgaatatcttgaatatgggaggagggggggctttgggtttcattgtgtgccctttcctgtccaacgtgagggttctagtgttatagggcgtggcagtgtttcttgagggctaatatcacgggtgaggcggttgtcacaggtgctagaccctggagttgaaccagtaccactcggttacaaagtcatggtctagtagttgtgaccctgcaaagctacgtggggatgagcagccagggactttggttgacaagcagacaggcggcgcattggaaccccagaggaatgtcccggggccacctctttggttctgtacatattttgttattgtacataaccatggagttggctgtggtgcactccatctggtaaggggggctggtgcggacgcctgtgtttagtctatgccaatgtttacctgccttgggttactattccaaacgaccacacctttaaggacacctggagccctgatcattctcggcttttactgccacctggcttctgttgggtcagacagtttggtgcgctagttgtgtgcttagcagcaacgcacaccaggctgactgccttagcagtgtggtcctttattgtggcatcctaaggagggattctggagtgcctttcacgtgaagcatgccctgagacgtactcgaggcagtactttaatcgctcatgtgccgctagatgagggagcgccaatttgtacatcctagctctggccatagagttagcccacccttgtgtctccctttggcctctgcggtgccaatttccggtggtttcccttttccgcccgtttatccaatagcatgtaagagaggtttcctagatttggcaactttgagggaacgttccgcgtagctggtgacctaagacccgcccatcaccaccggacagattctgaacttgtcctgtggtgtttggtgtggttttggggtacgcaggagtacgttggaatgctttggagccgagagggatgggcccgcttgtgcgcttatgtgttacacggtgccaataaccggcctggtgcggctgccccgtgacccgtgggccttaccttcctggccatcgggggaccctggtgctagggtcccttgtgttgctttctgccataggggggaaagcatcgccttcagaattggctgctccgttggaacatttgaggcctactgtatccgtgtcctgacaacattccccgcaaacacgacatgggttaatttaaacatgttttgtttgcttgggaatgctcttagggcccggaagcttgtcattggattcatcgtttcctgaactacaggcgtagggcctattgtagcaggcatgtcttcattcctgcgtaccgaatggcatgaaggcacagcctgttaccattggcaccttttttccatgtaaacctccgtgatcccgggtcctttggagactcaagtgtgaatttgttttggtgttcggcgccagggcatcttgacgttggaatgtcaactcaacttgggcacctcgataaccggctcgtggctcgtacagacgattgtttggctctgtaacttgccagggacggctgacgatgtgtttagtctgccacttgcatccggcgctttggttacacgggagactaatggggggtgtggtatggcacaggctgggggtgagtctggggatgtccctgggcgttgctgcagcccattcgccctctggggatgagatgttcaggggtggccggtaccctacgctgccgatttacataatataaattgtaaatgctgcagtagtagggatctggacgcgcgacctgctactcttcggaaacgccaacccaggagcgtcgcctctggccccatactcccgccatgcgactgctcgccccctcccaggcctccctggtgagcccttgccgctccccgcattcctgctttcggcgcccctgcggaccccgatgacagcaggccttcccttcccccgttaatgaaaagaatgacagagaggttgtgacagaaggacagctttattcagtttacagagtgccctcggaggctacgatattcccgttaaatgtcttgttgattctctcaaaggtggggagggaggagctctccacaacaatgttccctggcagcgtgagcgcgcagccctgccgttggatgtatcttctcatgatggtgctgatagaggggtctccggcgtagatgaaaaaggcctgggccatgctctggccggtcacgatcgttatggggttgttggaaatgttccggaccgtcagcttgagggtctggcccggcttccactcctgtgggtagacgtagaagaccgggttggaggagtgggacacgacaacggccgtaatcttggagctcaggggggcctcgtaggtgttgttgtattccagctccgtgatgaaattaggaggaataatcacaggggagccaaagtagcggatgtctgtggattccccgtcccagcgccagtggctcttagggtaggggttgtaatggaaggcaataatcacatcatccaatagggtcatgcccaccttgacgttcagcgggccctctcgtttcaggtccggcgtgtccacggagactcggacgtagcccttaccgcggcgtatggcgttgaccggacacaccttccccgggaatgtgtgaatacgggcgtatgactttagaaatgggggcgtgtgctgcgccagcaggtaaggcaggcactcgtcctggctggtgacgggagagccactgaggaagatctggggctcgctggtgtttagcttgtccccactctgggtgcaggagcgtgtcagctgaatgtcgctctgcccgggcagaatctgcaggtagaggtaggggttcttgaccaatctgatgggcacaatgtaccaggtaaacttccctttctctatgaacaggctgcgcggattcaggacgcttagcacgatgtcctggtcagagtgcataacgaagaagggcttgaggaatacctcgttgtcttccgctccaaagaacaagaacgcaaccgtaaagtagcggctgccgtaggtggtcgtgttgaaggagaaagaaggtaacttgaagctgagtatctggcccaccgaggggcagggaggcagctcttggcactgcgcgtccagctgcaatacctgcttgttggtgacgcgaacgtatgaggggaagatctcgtacttccacacgcctctcatgaacgacgtgtctggtttttcagtgggccgcaggcggcggaggctgttcctgaacgacgagcgccgggacgctagtgctgcatgggctcctccggggtaagcttcggccatggccggagctcgtcgacgggcaaggtgagagttggggggcgggcgacggtgcggccccaatacaactctccgctcgttagctggtagaatatccgcccggcgtctaggttgtcacttcgctcggccggccagaagagcgcaagtccaagtctggtgctggggccgatgtgcagcggtttgtgcccgcagttgtagactgtcatttttatgggcgagtgggcggtccacacgcgcgggcgcagcacccattggtcgcacgccgcctcctggaatgtaaacccccagagagagggcgtgccgccctggagatggccctgtgccatcacatgtatttcctccttgggtggaacgacggcgtcgtgctccgggtggagggggaatagcgtccaggcatctttcagggtcacgagaccggggtccatgcttagaaaacagccctcccgggcggtgggcggcccgggctccagcagaacgtcgcagacccagccctcctcggccctgtccacctgtatgtccaggtgcacggacccggaggctgcgtctcgtgacatggccaggcctggtgccagccgaccacgtcccgtgtcccagccgaggccacgccagagcagagcccgggactgactcagggccacatcccctcggcccgcggacgccgcctcgccagcccccgggccttcatgggcccgctttctacctctctccggcaccccagcctggtcagccgcagaggaagcatgaccttggggtgggacggggcaggcgtgatcctgggcgcaatctttgccgatccccacaccttcactccttgttaggttgatagaatgtcggtaccacgccacggggggcgggcccgcatagggaaaagccagggagagcgatgtgggcgaggatgggctcaggcggccccagacacgcaatttgcccccctgggcggccgcagcctgcccctcggcggcccgtgccccagctccgtcacggggggcgcataggaggggtatatctaggatagccgcacctacacaaatgagacacagacacaggtcatgaggatttaggcaacgcaggcttgtctttatagttacaaacatgggagcgtgcacctggaagatgcagctggggtagatctttacatctttacagggcgcagcagccgccagacactgaagggcagagttcacggcgggcacctcccagagggagcccaccagcccgtacctggccacggccagggcctcgtaggccgagacgggcagccggagcttgtggtactgtccctccggcaggtggagtgggacacagttagagaacattagtcctctggtccctatctccacccgccaggcctgtgtgtcagtttgcagggccatcctcgcgctcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttggggggtctttgccctcaaggtgaggctccttctaggaatgccgagccccctgcactagcttcgctccgctggggatctttgccagccttcatactagattcagcgatcccccggttgggaatcttcgccagcccccccgtcctgctatcctgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcctcggcaaagcgcagggtctcgctctctgaaaacccccggcactcgataaacagcgagtccgtgtccccgtagatgactcgaagctggccctcggggttgaggggcgcccaggcgtctggggacggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccaaacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatctgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccgcatggcaccacatacccctgtttatccgatggaatgacggcgcatttctcgtgcgtgtacaccgtctcaagtatgtcgtagacatggaagtctagagggcttccgtgggtgtctgcctccggccttgccgtgccctcttgggcacgctggcgccaccacatgccctttccatcctcgtcaccccccaccaccgtcagggagtcttggtagaaacacagggggggctgaggccctcgcacatccaccacccctgcggcgcctggggtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccaccaccaggaccagaatgagcatgccgccgaaggggtttttgaagaaggagatgaaacccgagaccaggctgctaaacaaaccccccaccgtgctgactaggttggtgatggactgacccacgctacccagactgtccataagttcccccaggccgtccacaaattgatttctgccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtaaggaagatctcgttgtcggtgcccagctgtccctcgtaggtcttggtgtcgttgataaagctgaaggacaccagggggcgcgagtagcacatggtctcggagccggggaccctcatgctcttgcgcagggtgacggtggcctggttaacgggcacgcactgggagactgagatgacatcccccaggcgcttggccgccaccgccttaccgtagatgctggacatgacggtggtgggattaatcttggttagttctctcagcaccatgttctgcctcttctgctccaggcaccaggcccgcgcaaggtctcccagcatgcggttgatctggcggcgcagggagtcgtaggcaaattggatctggacggtggcgggattgttgagggtgcccagggacttcccgggggccgcggggggcaccggtgtggtggcattccccgcattccgcctccggcgcctcagaacggcggcggaggtgctcccgcgggccgcgggtggggcggggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttttcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagcgtgtaagtgcccttgtccaggaaggctcggcgttcgccttgcgggttcgtccctcggttgtcgtagtccactatcttgtagttagttctcacgtggaaggagtctgcccgctcatggaaggtttccgtatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatctttaccgcgttgtagcactggtagatggtatccatctggtcagtttcgtagctctcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggcgcgggctgctctggggtctgcgcaccgaggcggcacgccagggcggctagcagcacgaccacgcttagcaccctacgccgagtcatctctcatttggaggtgcaggtagagaagggcatatagatccttaaatacccaccccctgcccttatacagaagaattaggggccggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaacgccttctggtgaggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtagagctcgttcctcttttgcaggatggcccggtactgggggtgcgccgtgaaggcggcggcgcagtccgccttcagcgcctccaccgcgtcgcccgaggagctgtagaccccgccgcagaagagccgctctgtggccccgggagccacggcatcaaacaggtgagtcagccttgcccccgccagcgcctcctcgcaggcccgccgcaccagggccaggcgacgctcccgggcaaacagggcagagaggcgggaatgtccgccaccctccccctgccccgttgcaccgatagcatggccgccagagttccaatagaggagctccgagagttccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagcccagcctgccggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtgcggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactcctggggtccagccgggcgcacacgctcagctcaaccgccagggcgtacacctggctgtacgccgccgccagcagccccgacatcgccgccccaggggtctctagacctcgagtccggggagaacggtggccagacggcgcttgcgcctgcccccggagccctgccctcctccacccagcagcagcccggccgaggcctgcgacgcggtgccgaccggctcggccacgctgataaagttgtcctgggctgccccgggcccaccccacactccctccagaaagtcccgagcggcccccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcgttctcccccgtgaagaccaccctgttcttgatcttgatgttcctggggcacagcatcagcaccttggacatgcgcaccggcagccgccggccgtacacccggccctgcagggccgcgtcgaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacaactgggtgaagacggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccctcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatggggctggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccaccgcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtaaaggacggaattggtggcaaagatctgcgtggacacgtggggggccaggctggcattatatcggtgtaacgcagccatacgggcctctgggccctcacagtcggcaaacaggggccaagagtcgtagttgaggcttgccggggtctcgtgcgaggcctccagcatggcgggcgcgtaactcaccgccagctcgcaggccgcgctgtccacaatcattaaggctcccgagtccgggtgactgatggttgaggctgggaactccttgaggggggccaccttggccaccttggcctggtcctgcaggctctgcttctccagcagctctaccagcttgcccacccgccggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttctctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctctgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcttcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgcgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtctcgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatggggacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatatgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggcagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcccggtagttgtgttgtgcagaggtctgatgtgtgtaggaggggtgggttcaacgcaggggcgttggtggcggagtctggcaacgcccgggtccttgctacctgtgtggtgtgtgaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagtacccaaaagcagcgtaggaaggtgtggatcaccgccgccaccgtctgtcatcgaaggcgggtcccggtcacctcctttgttttcaacctcttccgtcaaatttggagggcctccatcatttccagcagagtcgctagggttatgaggcagcgggtcatgtgggccattgtcatcagtgttgtcagggtcctgtgggccattgtcatcagtgttgtcagggtcctgtgggccattgtcatcagtgttgtcagggtcctgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggccccactcacgagcaggtggtgtctgccctcgttggagttagagtcagattcatggctagaatcgtcggtagcttgttgagggtgcgggagggagtcatcgtggtggtgttcatcagtgtgtcgtggtccatgataatacatccagattaaaatggccataaacaggaggagccaaaggagatcaaccaatagagtccaccagttttgttgtagatagagagcaataataagcaggatgatggctaggaagaaggctaggatgaaggccaaaagctgccagatggtggcaccaagccgccagagaatctccaagaagtagatccagagacctaagactgcgttgaaaaaaagagtgttagggctggaaaggtgagggtgtggtaaataagtcctagggaatgttagatcttaccaagtaagcagccaaagatgaacagcacaattccaaggtacaatgcctgtccgtgcaaattccagagagcgatgagtaggagggtgactggggaaagaggagaaagtgcgttagagaaggaagcgtaagggaaagggggtggggggcaaagggtgtaatacttactcatcagtaggagtagaccaaggcctccaagtggacagagaaggtctcttctgaagataaagatgatgagaatgataataataagcatgagagcaaaggaatagaggacaaggagcgctcctccagtccagttactcataacgatatacagccagaacagtagcgccaagagcaggagaaggagagcaaggcctatggaagaggagagggggggtcctagagggggccgtggcgggcccggtgggcccctctcaaggtcgcgttccatggtcagggtagtgtggcaggagcaaggcaactgaggaaagaagctgacagagcagtgacagaggcttatgtaggccgcctacgagagagcaacgcgtgtttctggggatggaggcccggggggatttgcggggtctgccggaggcagtacgggcgccgctttcccgaaagcggcgtagtgtgtgtgcatgtaagcgttaaaagaggaagtagaaagcgtgtgtttgtgttagaaaagcgagtccccgaggggcaagctgtgggaatgcggtggtaaagcgtagcaggaaatggaaaggcagtgcggcaatcacaagggggagtgagcagtgttgtgggaagcggcagtgtaatccacacaaagaggcgtagggcgcgcaacgttgggaggtcgttgtcggcaggcgggaggctgtgctttaggggggttcaggtgaggcaaggctgtggggtaaccgtaggggaggcgggtgaggcggataagagggctaagggtcggcgggtgacgaagcagcagacgggggatatgggaatttcagaatgaggtggcggattccggcgaaaagggtgtgggctgtgcaagtgtcatgaggcaggcgcggaaagtcgctgcggcttgctggcgtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatgggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatgg

The invention claimed is:

1. A method for vaccinating a subject, the method comprising:
   (A) contacting said subject with
      (i) a composition comprising Epstein-Barr Virus (EBV) particles, wherein said EBV particles comprise a reduced chromosome instability-inducing EBV polypeptide activity,
      (ii) a polynucleotide encoding an EBV genome, wherein said EBV genome
         a) lacks a gene encoding a functional chromosome instability-inducing EBV polypeptide and/or lacks a gene encoding a functional EBV fusogenic polypeptide, and
         b) lacks EBV terminal repeat sequences and/or lacks at least one functionally expressible gene selected from the BFLF1 gene and the BBRF1 gene,
      (iii) a vector comprising the polynucleotide of (ii),
      (iv) a host cell comprising the polynucleotide of (ii) or the vector of (iii), or
      (v) any combination of (A)(i) to (A)(iv); and
   (B) thereby, vaccinating said subject while avoiding induction of chromosomal aberrations by said vaccination,
   wherein said subject is a human of less than 18 years of age, is suffering from immunodeficiency, is planned to undergo immunosuppressive treatment, is planned to undergo a transplant, or is any combination thereof.

2. The method of claim 1, wherein said EBV particles are free of EBV DNA.

3. The method of claim 1, wherein said EBV particles are free of a functional BNRF1 polypeptide, of a functional BPLF1 polypeptide, of a functional BGLF3 polypeptide, of a functional BRRF2 polypeptide, of a functional BKRF4 polypeptide, and/or of a functional BXLF1 polypeptide.

4. The method of claim 1, wherein said EBV particles are free of BNRF1 gene products.

5. The method of claim 1, wherein said EBV particles further comprise at least one non-EBV polypeptide, preferably an artificial non-EBV polypeptide.

6. The method of claim 1, wherein said EBV particles further lack at least one non-essential EBV polypeptide activity, preferably lack EBV gp110 activity; and/or further lack at least one transforming EBV polypeptide.

7. The method of claim 1, wherein said vaccination comprises avoiding contacting the cytosol and/or nucleus of cells of said subject with a chromosome instability-inducing EBV polypeptide activity.

8. The method of claim 7, wherein said avoiding contacting the cytosol and/or nucleus of cells of said subject with a chromosome instability-inducing EBV polypeptide activity comprises avoiding contacting said subject with a BNRF1 polypeptide, and/or comprises avoiding contacting said subject with an EBV particle comprising EBV fusogenic polypeptide activity.

9. The method of claim 7, wherein said avoiding contacting the cytosol and/or nucleus of cells with a chromosome instability-inducing EBV polypeptide activity comprises avoiding contacting said subject with a BNRF1 gene product, preferably comprises avoiding contacting said subject with a BNRF1 polypeptide.

10. The method of claim 7, wherein said avoiding contacting the cytosol and/or nucleus of cells with a chromosome instability-inducing EBV polypeptide activity comprises avoiding contacting said subject with an EBV particle comprising EBV fusogenic polypeptide activity.

11. The method of claim 1, wherein said composition comprises a significantly reduced BNRF1 activity and/or a significantly reduced gp110 activity.

12. The method of claim 1, wherein said composition comprises EBV particles devoid of BNRF1 activity and/or devoid of gp110 activity.

13. The method of claim 1, wherein said composition is devoid of BNRF1 activity and/or devoid of gp110 activity.

* * * * *